(12) United States Patent
Von Gabain et al.

(10) Patent No.: US 8,617,574 B2
(45) Date of Patent: Dec. 31, 2013

(54) NONTYPABLE HAEMOPHILUS INFLUENZAE ANTIGENS

(75) Inventors: Alexander Von Gabain, Vienna (AT); Eszter Nagy, Vienna (AT); Andreas Meinke, Pressbaum (AT); Sanja Selak, Vienna (AT); Markus Hanner, Pressbaum (AT); Margarita Smidt, Vienna (AT); Michaela Weissgram, Hinterbruhl (AT); Birgit Noiges, Vienna (AT); Stefan Seidel, Wiener Neustadt (AT); Julia Bacher, Vienna (AT); Christina Satke, Moedling (AT); Wolfgang Schueler, Vienna (AT); Martin Oleksiewicz, Vienna (AT)

(73) Assignee: Valneva Austria GmbH, Vienna (AT)

( * ) Notice: Subject to any disclaimer, the term of this patent is extended or adjusted under 35 U.S.C. 154(b) by 0 days.

(21) Appl. No.: 13/148,695

(22) PCT Filed: Feb. 15, 2010

(86) PCT No.: PCT/EP2010/051871
§ 371 (c)(1),
(2), (4) Date: Nov. 9, 2011

(87) PCT Pub. No.: WO2010/092176
PCT Pub. Date: Aug. 19, 2010

(65) Prior Publication Data
US 2012/0045457 A1    Feb. 23, 2012

(30) Foreign Application Priority Data
Feb. 13, 2009 (EP) .................................... 09152796

(51) Int. Cl.
*A61K 39/102* (2006.01)
*C12P 21/04* (2006.01)
*C07K 14/195* (2006.01)

(52) U.S. Cl.
USPC .................. 424/256.1; 424/164.1; 424/190.1; 530/300; 530/350; 435/69.7

(58) Field of Classification Search
None
See application file for complete search history.

(56) References Cited

U.S. PATENT DOCUMENTS 7,241,867 B2 * 7/2007 Bakaletz et al. ............... 530/350
7,749,518 B2 * 7/2010 Masignani et al. ........ 424/256.1

FOREIGN PATENT DOCUMENTS

WO   WO-01/61013 A1   8/2001
WO   WO-2006/138527 A2   12/2006

OTHER PUBLICATIONS

Gnehm et al J Clin Invest. May 1985; 75(5): 1645-1658.*
Cripps et al., Prospects for a vaccine against otitis media. Expert Rev Vaccines. Aug. 2006;5(4):517-34.
Foxwell et al., Nontypeable *Haemophilus influenzae*: pathogenesis and prevention. Microbiol Mol Biol Rev. Jun. 1998;62(2):294-308.
Hornef et al., Bacterial strategies for overcoming host innate and adaptive immune responses. Nat Immunol. Nov. 2002;3(11):1033-40.
Kulbachinskiy et al., Methods for selection of aptamers to protein targets. Biochemistry (Mosc). Dec. 2007;72(13):1505-18.
Marcy, New guidelines on acute otitis media: an overview of their key principles for practice. Cleve Clin J Med. Jun. 2004;71 Suppl 4:S3-9.
Murphy, Vaccine development for non-typeable *Haemophilus influenzae* and *Moraxella catarrhalis*: progress and challenges. Expert Rev Vaccines. Dec. 2005;4(6):843-53.
Rao et al, Molecular determinants of the pathogenesis of disease due to non-typable *Haemophilus influenzae*. FEMS Microbiol Rev. Apr. 1999;23(2):99-129.

* cited by examiner

*Primary Examiner* — Padma V Baskar
(74) *Attorney, Agent, or Firm* — Wolf, Greenfield & Sacks, P.C.

(57) ABSTRACT

The present invention relates to isolated nucleic acid molecules which encode an antigen from a nontypable *Haemophilus influenzae* (*H. influenzae*) species, a vector which comprises such nucleic acid molecule, and a host cell comprising such vector. Furthermore, the invention provides antigens from a nontypable *Haemophilus influenzae* species, as well as fragments and variants thereof, a process for producing such antigens, and a process for producing a cell, which expresses such antigen. More specifically such antigens are produced by or associated with bacterial infections caused by nontypable *Haemophilus influenzae*. Moreover, the present invention provides antibodies binding to such antigen, a hybridoma cell producing such antibodies, methods for producing such antibodies, a pharmaceutical composition comprising such nucleic acid molecule, antigen, vector or antibody, the use of such nucleic acid molecule, antigen, vector or antibody for the preparation of a pharmaceutical composition, methods for identifying an antagonist capable of binding such antigen or of reducing or inhibiting the interaction activity of such antigen, methods for diagnosing an infection with nontypable *Haemophilus influenzae* and methods for the treatment or prevention of an infection with nontypable *Haemophilus influenzae*.

8 Claims, 6 Drawing Sheets

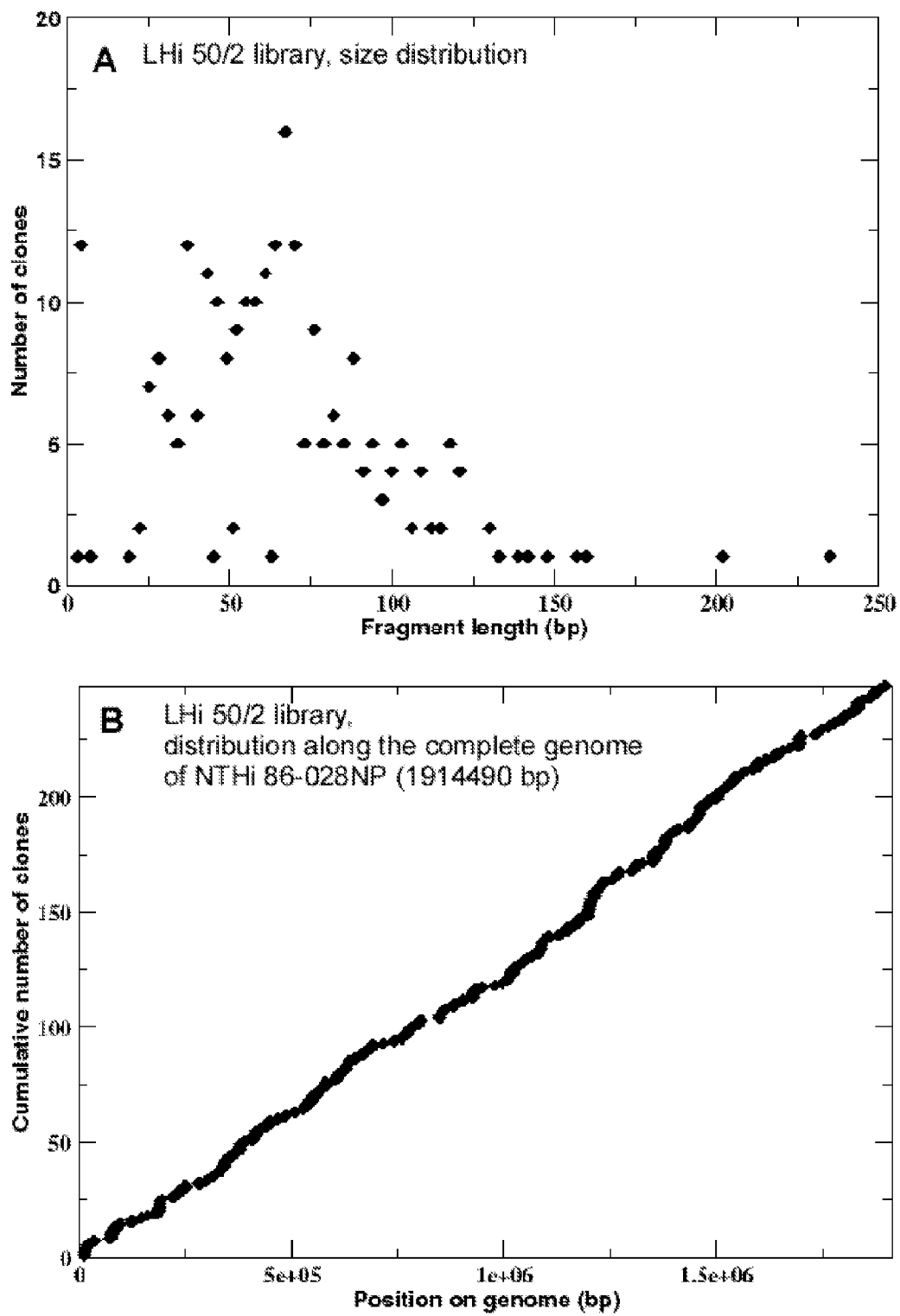
Figure 2 A, B.

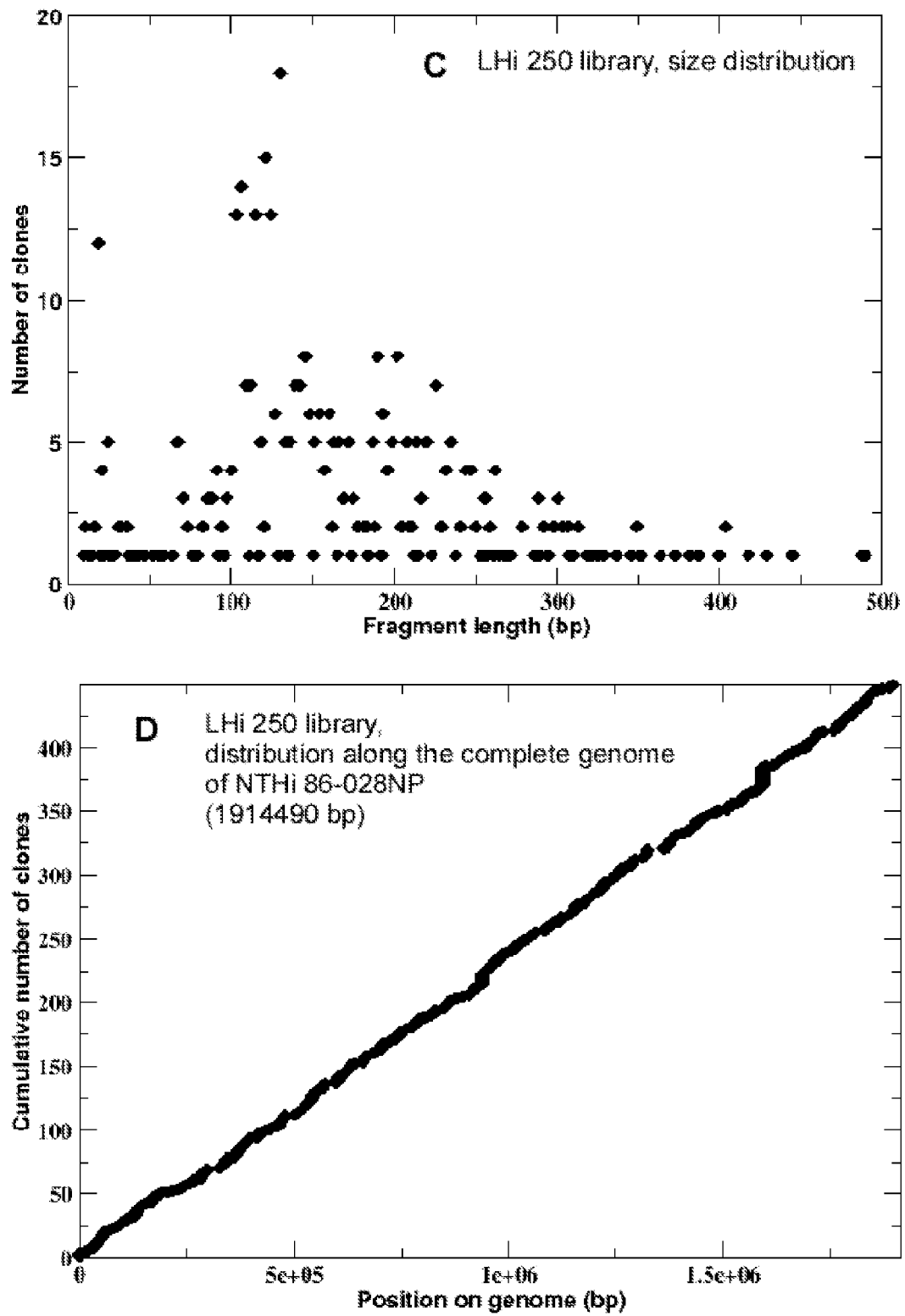
Figure 2 C, D.

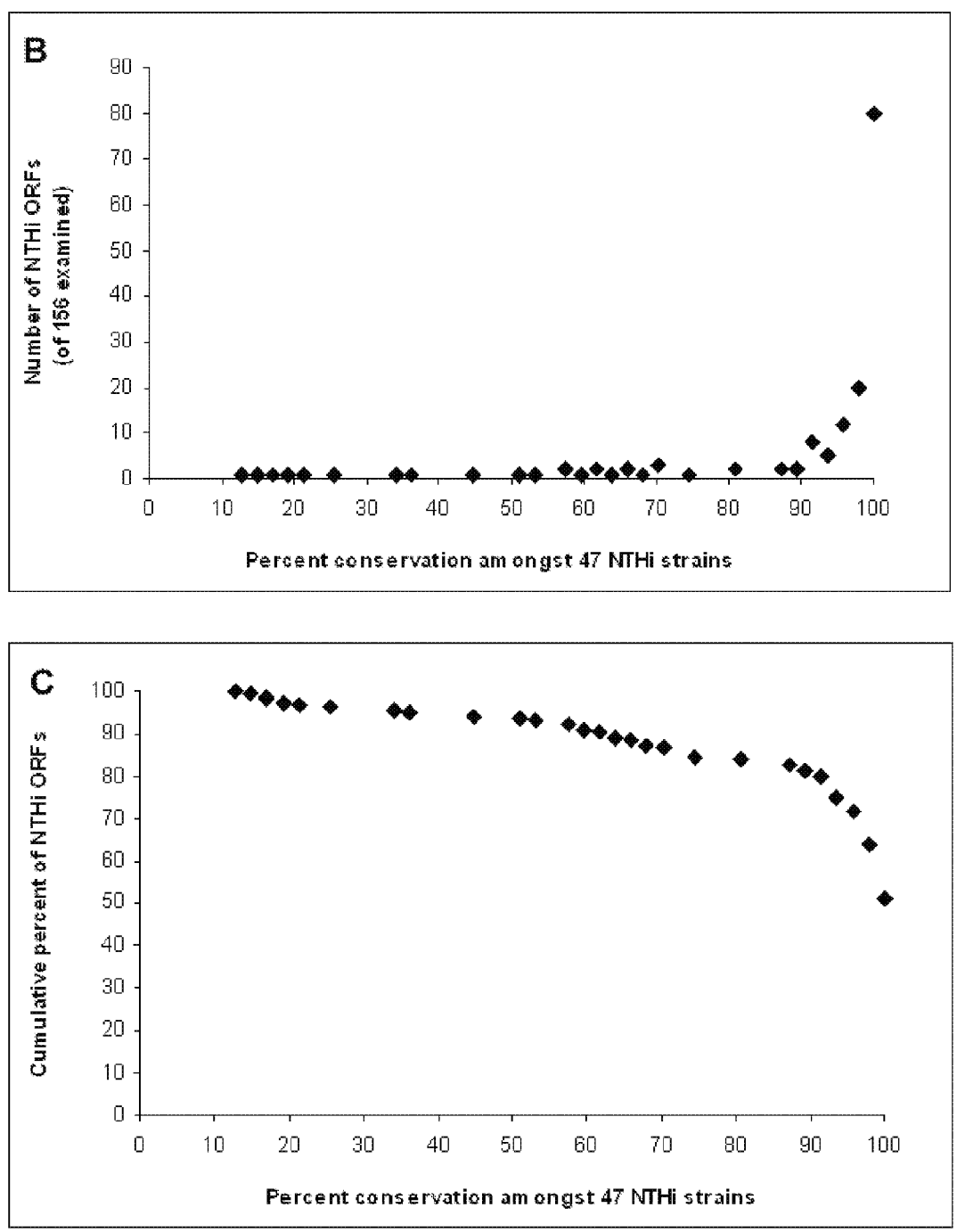
Figure 3 B, C.

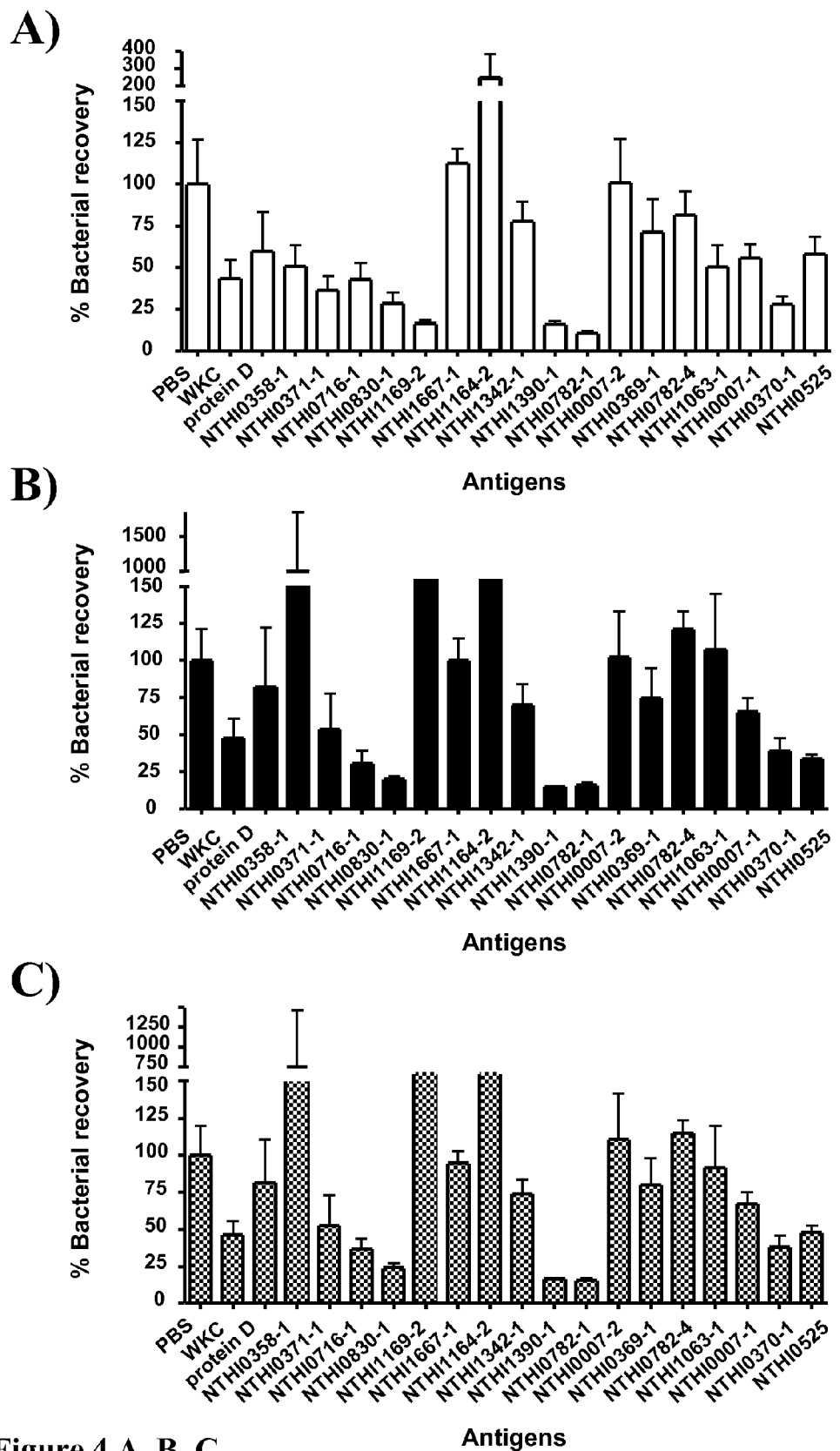
Figure 4 A, B, C.

NONTYPABLE *HAEMOPHILUS INFLUENZAE* ANTIGENS

RELATED APPLICATION

This application is a national stage filing under 35 U.S.C. §371 of international application PCT/EP2010/051871, filed Feb. 15, 2010, which was published under PCT Article 21(2) in English.

The present invention relates to isolated nucleic acid molecules which encode an antigen from a nontypable *Haemophilus influenzae* (*H. influenzae*) species, a vector which comprises such nucleic acid molecule, and a host cell comprising such vector. Furthermore, the invention provides antigens from a nontypable *Haemophilus influenzae* species, as well as fragments and variants thereof, a process for producing such antigens, and a process for producing a cell, which expresses such antigen. More specifically such antigens are produced by or associated with bacterial infections caused by nontypable *Haemophilus influenzae*. Moreover, the present invention provides antibodies binding to such antigen, a hybridoma cell producing such antibodies, methods for producing such antibodies, a pharmaceutical composition comprising such nucleic acid molecule, antigen, vector or antibody, the use of such nucleic acid molecule, antigen, vector or antibody for the preparation of a pharmaceutical composition, methods for identifying an antagonist capable of binding such antigen or of reducing or inhibiting the interaction activity of such antigen, methods for diagnosing an infection with nontypable *Haemophilus influenzae* and methods for the treatment or prevention of an infection with nontypable *Haemophilus influenzae*.

*Haemophilus influenzae* is a Gram-negative, facultatively anaerobic coccobacillus. The bacterium exists exclusively associated with human epithelia, and is absolutely dependent on exogenous NAD (factor V) and a source of heme (factor X) for aerobic growth (Rao et al., 1999; Foxwell et al., 1998).

Depending on the presence of a polysaccharide capsule, isolates of *H. influenzae* are divided into encapsulated and non-encapsulated strains. There are six types of encapsulated strains designated a-f, which express distinct capsular polysaccharides, and which can be differentiated by their ability to agglutinate with antisera against the respective polysaccharide. Non-encapsulated *H. influenzae* strains obviously do not react with anti-capsule antisera, and such strains are termed nontypable *H. influenzae* (NTHi). Typing systems for NTHi include biotyping, classification of outer membrane protein molecular weight, genetic classification by electrophoresis or PCR, and others (Foxwell et al., 1998).

With the advent of high-throughput sequencing methods, whole-genome sequencing is now also used to characterize NTHi strains. The first NTHi strain to be sequenced was 86-028 NP, a pathogenic strain isolated from the nasopharynx of a child with chronic otitis media. NTHi 86-028 NP was found to have a genome size of about 1.9 million bp, and 1,821 genes could be identified (Harrison et al., 2005). Since, additional NTHi sequences have appeared, showing clear genetic differences between NTHi strains (Hogg et al., 2007).

Pathogenesis of NTHi Infection

NTHi are human epithelial commensals, that can in some cases also cause disease, affecting the epithelial linings of the middle ear (otitis media, OM), lower respiratory tract, sinuses, and urogenital tract. In children, OM is typically seen. In adults, lower respiratory tract infections with NTHi are secondary complications to chronic obstructive lung disease (Murphy 2005).

Most children encounter NTHi colonization by the age of 1 year, and colonization occurs more frequently in the winter months (Murphy 2005). The triggers for the switch from a commensal to a pathogenic lifestyle are thought to include host, microorganism as well as environmental and lifestyle factors. Thus, respiratory viral infections, cigarette smoke, bottle feeding or use of pacifiers in young children, and co-morbidity such as chronic obstructive pulmonary disease (COPD) in adults, are all thought to predispose for NTHi infection (Murphy 2005; Marcy 2004). Key to NTHi pathogenesis is the ability to bind to the human respiratory tract epithelial layer. NTHi exhibits a high degree of specificity towards the epithelia of the nasopharynx, eustachian tubes and middle ear (Foxwell et al., 1998). Interactions with epithelial cells occur through bacterial membrane proteins such as P2, P5, HMW1, HMW2, *Haemophilus influenzae* adhesin (Hia), Hap and others (Rao et al., 1999; Foxwell et al., 1998). Likewise, bacterial products such as lipooligosaccharide (LOS) can damage epithelial cells and the epithelial ciliary apparatus, which may interfere with clearance of NTHi from the respiratory tract (Rao et al., 1999; Foxwell et al., 1998). In fact, NTHi is thought to preferentially bind to damaged epithelia. In addition to adhering to epithelial surfaces, NTHi appear to be able to penetrate epithelial layers, and to survive intracellularly within epithelial cells (Foxwell et al., 1998). Finally, NTHi has an elaborate system to ensure an adequate iron supply from its human host (Rao et al., 1999).

Following colonization, a number of factors are thought to help NTHi maintain its presence on epithelia despite the host immune response. Such immune-evasive factors include the IgA1 protease, which can cleave mucosal IgA antibodies in the hinge region, releasing two Fab domains, and the Fc part of the IgA1 molecule (Rao et al., 1999). Also, bacterial products such as lipooligosaccharide (LOS) may allow the bacterium to modulate the immune response in a way favorable to bacterial survival (Foxwell et al., 1998). Finally, bacterial proteins are known to exhibit antigenic drift, allowing evasion of host immune responses.

Otitis Media

Otitis media (OM) is a disease of children. OM is very prevalent, affecting 75% of children before the age of 3 years (Cripps and Otczyk 2006). Clinically, acute OM is defined by an abrupt onset of middle ear effusion and inflammation, diagnosed by various methods to visualize bulging of the tympanic membrane, and presence of effusion in the middle ear cavity (Marcy 2004). Typically, acute OM is preceded by an upper respiratory tract infection 3-5 days prior, and acute OM is often associated with ear pain (Marcy 2004). In some children, OM becomes recurrent and persistent, causing problems with hearing, and speech and language development (Cripps and Otczyk 2006). Treatment of OM is initially symptomatic, with more severe cases requiring antibiotic treatment or tympanostomy tube placement and adenoidectomy (Marcy 2004, Cripps and Otczyk 2006). Due to the high prevalence, OM constitutes a major burden to children and the health system. OM is the main presentation in young children visiting medical practitioners, and OM is the reason for over half of the antibiotics prescribed to children below 3 years in the US (Cripps and Otczyk 2006). Finally, the prevalence of OM has been reported to have increased over the last decades in several industrialized countries such as Finland, USA and Australia (Cripps and Otczyk 2006).

While environmental or host factors compromising the integrity of the nasopharyngeal epithelium predispose to OM, the ultimate cause of OM is infectious, comprising bacteria (NTHi, *Streptococcus pneumoniae*, *Moraxella catarrhalis*) as well as viruses (respiratory syncytial virus, rhinovirus, influenza virus, parainfluenza virus, metapneumovirus and coronavirus). Bacteria are isolated from the majority (~80%) of OM cases, with NTHi incidence appearing to rise in recent years. NTHi infection is currently thought to be responsible for 35-50% of acute otitis media cases (Cripps and Otczyk 2006, Marcy 2004). NTHi is sensitive to beta lactam antibiotics (ampicillin, amoxicillin). In recent years, antibiotic resistance associated with β-lactamase production has been reported in NTHi (Rao et al., 1999; Cripps and Otczyk 2006). Vaccination is known to be protective against OM. For example, influenza virus vaccination can reduce acute OM incidence in children during the influenza season (Marcy 2004). Also, vaccination with a pneumococcal conjugate vaccine, containing polysaccharide antigens of 7 serotypes conjugated to a nontoxic diphtheria toxin variant, has been shown to reduce acute OM incidence (Marcy 2004; Cripps and Otczyk 2006). However, use of pneumococcal vaccine has been shown to cause "pathogen replacement", i.e., increased incidence of acute OM cases caused by pneumococcal serotypes not covered by the vaccine, or caused by other pathogens such as NTHi, *Moraxella catarrhalis, Streptococcus pyogenes* and *Staphylococcus aureus* (Cripps and Otczyk 2006). Pathogen replacement likely contributes to the protective effect of the heptavalent pneumococcal vaccine against acute OM to vary between studies, with the clearest protective effect being against OM recurrence and tympanostomy need (Murphy 2004). Also, pathogen replacement is thought to provide selective pressure for spread of penicillin resistance to non-vaccine pneumococcal serotypes (Cripps and Otczyk 2006).

Vaccination Against Otitis Media

It follows from the above, that availability of a NTHi vaccine would be of major benefit in preventing OM in young children, as well as NTHi infections in adults with chronic obstructive pulmonary disease. In fact, the development of a NTHi vaccine has been given high priority by the NIAID (Cripps and Otczyk 2006). Based on the experience that pneumococcal polysaccharide conjugate vaccine causes pathogen replacement, it can be hypothesized that an ideal NTHi vaccine would comprise NTHi proteins (as opposed to carbohydrates), that are highly conserved across clinical strains. A number of candidate vaccine antigens, comprising mainly glycoconjugate antigens, lipooligosaccharide antigens (LOS) and abundant NTHi membrane proteins, have been identified, and are in clinical trials (Cripps and Otczyk 2006). However, as regards protein-based vaccines, the candidate antigens comprise essentially the 10 most abundant NTHi surface proteins (Cripps and Otczyk 2006; Foxwell et al., 1998; Murphy 2005). Thus, it appears very likely that additional vaccine candidate antigens based on NTHi proteins can be found by appropriately designed screening methods. Based on current knowledge of NTHi pathogenesis outlined above, NTHi protein vaccine antigens should be sought amongst NTHi membrane proteins that are (i) expressed and surface exposed during colonization of human epithelia, (ii) induce antibody responses in humans, (iii) with antibodies preventing adhesion to human nasopharyngeal cells, and/or exhibiting bactericidal activity in vitro. Preclinical in vivo confirmation of vaccine antigens could be done in animal models of otitis media, of which several are available, e.g. chinchilla, rats and mice (Cripps and Otczyk 2006). Finally, in early clinical trials, a number of early indicators of vaccine efficacy can be envisaged in adults, e.g. the magnitude as well as functionality of antibody responses with regards to bactericidal activity or prevention of adhesion of NTHi to respiratory tract epithelial cells, as well as the incidence of nasopharyngeal colonization with NTHi in vaccinees (Cripps and Otczyk 2006).

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short, usually 8-11 amino acids long, peptides in conjunction with major histocompatibility complex (MHC). B-cells can recognize linear epitopes as short as 4-5 amino acids, as well as three-dimensional structures (conformational epitopes).

In order to obtain sustained, antigen-specific immune responses, adjuvants need to trigger immune cascades that involve all cells of the immune system. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and other factors that may be co-injected. In addition, the adjuvant may act as a chemoattractant for other immune cells or may act locally and/or systemically as a stimulating agent for the immune system.

The antibodies produced against nontypable *Haemophilus influenzae* by the human immune system and present in human sera are indicative of the in vivo expression of the antigenic proteins and their immunogenicity. The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce T cells and antibodies against the selected proteins in vivo.

In addition to the T cell-mediated immune response, antibodies against cell wall proteins induced by B cell epitopes may aid the T cell-mediated immune response and serve multiple purposes: they may inhibit adhesion, interfere with nutrient acquisition, inhibit immune evasion and promote phagocytosis (Hornef, M. et al., 2002). Antibodies against secreted proteins are potentially beneficial in neutralization of their function as toxin or virulence component. It is also known that bacteria communicate with each other through secreted proteins. Neutralizing antibodies against these proteins will interrupt growth-promoting cross-talk between or within chlamydial species. The described experimental approach is based on the use of antibodies specifically induced by nontypable *Haemophilus influenzae* purified from human serum. The antigens identified by the genomic screens are thereby shown to be expressed in vivo in the host and to be capable of inducing an antibody response. Since it has been shown for many proteins that B cell and T cell epitopes reside in the same protein, the most promising candidates identified by the genomic screens can be further evaluated for the induction of a potent T cell response in vivo. As a first step, bioinformatic analyses have been used to identify potential T cell epitopes in silico, which can then be tested in the appropriate murine model of infection. Thus the present invention combines the experimental identification of immunogenic proteins with the bioinformatic prediction of T cell epitopes in order to provide candidates for an efficient vaccine to treat or prevent *Haemophilus* infections.

The problem underlying the present invention was to provide means for the development of pharmaceutical compositions such as vaccines against infections caused by nontypable *Haemophilus influenzae*. More particularly, the problem was to provide an efficient, relevant and comprehensive set of nucleic acid molecules or antigens, or fragments or variants thereof, from nontypable *Haemophilus influenzae* that can be used for the preparation of said pharmaceutical compositions. A still further problem was to provide methods and means for producing an antigen, a fragment or variant thereof. Yet another problem was to provide pharmaceutical compositions comprising said nucleic acids or said antigens. A still further problem of the invention was to provide antibodies, pharmaceutical compositions comprising said antibodies, methods for the production of said antibodies and the use of said antibodies for the preparation of a pharmaceutical preparation. Furthermore, the object of the present invention was to provide methods for identifying an antagonist capable of binding an antigen, or a fragment or variant thereof, as well as to provide methods for identifying an antagonist capable of reducing or inhibiting the interaction activity of such an antigen to its interaction partner. A further problem of the present invention was to provide methods for diagnosing an infection with a nontypable *Haemophilus influenzae* organism. Still another problem underlying the invention was to provide methods for treating nontypable *Haemophilus influenzae* infections, and to provide methods for immunizing an animal or human.

The problem underlying the present invention is solved in one aspect by an isolated nucleic acid molecule encoding an antigen or a fragment thereof, comprising a nucleic acid sequence, which is selected from the group consisting of:
  a) a nucleic acid molecule having at least 70% sequence identity to a nucleic acid molecule having a nucleotide sequence selected from the group consisting of SEQ ID NOs 636 to 641, 643, 646, 648 and 1 to 156,
  b) a nucleic acid molecule which is complementary to the nucleic acid molecule of a),
  c) a nucleic acid molecule comprising at least 15 sequential bases of the nucleic acid molecule of a) or b),
  d) a nucleic acid molecule which anneals under stringent hybridisation conditions to the nucleic acid molecule of a), b), or c), and
  e) a nucleic acid molecule which, but for the degeneracy of the genetic code, would hybridise to the nucleic acid molecule defined in a), b), c), or d).

In an embodiment of the invention the sequence identity to SEQ ID NOs 636 to 641, 643, 646, 648 or 1 to 156 is at least 80%, more preferably at least 90%, still more preferably at least 95%, 96%, 97%, 98%, or 99%, or most preferably 100%.

In an embodiment the nucleic acid is DNA.

In an alternative embodiment the nucleic acid is RNA.

In still another embodiment the nucleic acid molecule is isolated from a genomic DNA, preferably from a nontypable *Haemophilus influenzae* species.

In an embodiment of the invention the encoded antigen fragment is an active fragment or an active variant thereof.

In an embodiment the nucleic acid encodes an antigen or fragment thereof, which comprises or consists of a polypeptide or peptide fragment from nontypable *Haemophilus influenzae*.

The problem underlying the present invention is further solved by a vector comprising a nucleic acid molecule as described above.

In an embodiment the vector is adapted for recombinant expression of the antigen, or fragment thereof, encoded by the nucleic acid molecule as defined above.

The present invention also relates to a host cell comprising the vector as defined above.

The problem underlying the present invention is solved in a further aspect by an antigen that is immunologically reactive with sera from a human having a nontypable *Haemophilus influenzae* infection, or an uninfected healthy human who was previously infected with nontypable *Haemophilus influenzae*, wherein the antigen comprises an isolated polypeptide or an active fragment or an active variant thereof from nontypable *Haemophilus influenzae*.

The term "uninfected healthy human" as used herein comprises those individuals who have or had multiple encounters with the pathogen, which may result in colonization, but which either do not result in any symptoms, or which result in mild diseases. Said term and the rationale of selecting sera of uninfected healthy humans for antigen identification is further defined in Nagy, E. et al., (2003).

Another aspect of the present invention relates to an antigen, comprising or consisting of an isolated polypeptide selected from the group consisting of SEQ ID NOs 656 to 661, 663, 666, 668 and 157 to 312, or an active fragment or an active variant thereof.

In an embodiment of the invention said polypeptide is encoded by a nucleic acid molecule as defined above.

In another embodiment the active fragment of the antigen consists of at least 50%, especially at least 60%, preferably at least 70%, more preferably at least 80%, still more preferably at least 90%, even more preferably at least 95%, 96%, 97% or 98%, most preferably 99% of said polypeptide, especially of a polypeptide as defined by any of the SEQ ID NOs 656 to 661, 663, 666, 668 or 157 to 312.

In an embodiment the active variant of the antigen has at least 50%, especially at least 60%, preferably at least 70%, more preferably at least 80%, still more preferably at least 90%, even more preferably at least 95%, 96%, 97% or 98%, most preferably 99% sequence identity to said polypeptide, especially to a polypeptide as defined by any of the SEQ ID NOs 656 to 661, 663, 666, 668 or 157 to 312.

The additional amino acid residue(s) may be homologous to the antigen as defined above. Homologous refers to any amino acid residue(s) which is/are identical or similar to the amino acid sequence of the nontypable *Haemophilus influenzae* antigen from which the fragment is derived.

Alternatively or additionally, the polypeptide may comprise or consist of the antigen, optionally the additional sequence as defined above and at least one amino acid residue heterologous to the antigen.

In an embodiment of the invention, the antigen further comprises or consists of at least one amino acid residue heterologous to the antigen, preferably an amino acid sequence of a marker protein.

The additional sequence or amino acid residue(s) as defined above consist(s) of (an) amino acid residue(s), which may be any amino acid, which may be either an L- and/or a D-amino acid, naturally occurring and otherwise. Preferably the amino acid is any naturally occurring amino acid such as alanine, cysteine, aspartic acid, glutamic acid, phenylalanine, glycine, histidine, isoleucine, lysine, leucine, methionine, asparagine, proline, glutamine, arginine, serine, threonine, valine, tryptophan or tyrosine.

However, the amino acid may also be a modified or unusual amino acid. Examples of those are 2-aminoadipic acid, 3-aminoadipic acid, beta-alanine, 2-aminobutyric acid, 4-aminobutyric acid, 6-aminocaproic acid, 2-aminoheptanoic acid, 2-aminoisobutyric acid, 3-aminoisobutyric acid, 2-aminopimelic acid, 2,4-diaminobutyric acid, desmosine, 2,2'-diaminopimelic acid, 2,3-diaminopropionic acid, N-ethylglycine, N-ethylasparagine, hydroxylysine, allo-hydroxylysine, 3-hydroxyproloine, 4-hydroxyproloine, isodesmosine, allo-isoleucine, N-methylglycine, N-methylisoleucine, 6-N-methyllysine, N-methylvaline, norvaline, norleucine or ornithine. Additionally, the amino acid may be subject to modifications such as posttranslational modifications. Examples of modifications include acetylation, amidation, blocking, formylation, gamma-carboxyglutamic acid hydroxylation, glycosilation, methylation, phosphorylation and sulfatation. If more than one additional or heterologous amino acid residue is present in the peptide, the amino acid residues may be the same or different from one another.

The feature "heterologous amino acid" or "amino acid heterologous to the antigen" refers to any amino acid which is different from that amino acid located adjacent to the antigen in any naturally occurring protein of nontypable *Haemophilus influenzae*. Therefore, the protein of the invention encompassing at least one heterologous amino acid refers to a protein which is different from any naturally occurring protein of nontypable *Haemophilus influenzae* or fragments thereof.

In one embodiment, the additional amino acid residue(s) is/are flanking the antigen N-terminally, C-terminally or N- and C-terminally.

In another embodiment, the antigen further comprises or consists of either a leader or a secretory sequence, a sequence employed for purification, or a proprotein sequence.

The problem underlying the present invention is solved in another aspect by an antigen, whereby the antigen comprises a core amino acid sequence as indicated in Table 4, whereby more preferably the core amino acid sequence is selected from the group consisting of amino acids 9-14, 23-44, 49-65, 68-74, 82-87, 91-104, 106-112, 115-123, 181-187, 192-215, 231-239, 244-250, 261-267, 272-283, 291-301, 305-312, 314-321, 361-378, 388-400, 412-420, 432-440, 467-475, 486-492, 494-505, 507-514, 533-550, 557-570, 583-591, 615-627, 652-662, 690-701, 727-733, 744-749, 782-790, 839-848, 857-863, 870-882, 895-902, 914-930, 954-964, 970-982, 1016-1023 2-87, 103-125, 127-205, 219-324, 334-647, 653-673, 676-701, 720-760, 768-798, 801-823, 827-856, 867-887, 891-928, 938-997, 1009-1028 3-21, 33-64, 94-192, 419-491, 626-705, and 763-808 of SEQ ID NO 157; amino acids 27-56, 67-86, 93-101, 112-119, 138-145, 152-177, 181-187, 249-298, 303-309, 315-320, 323-328, 332-351, 362-370, 398-406, 453-462, 468-483, 496-512, 514-520, 528-533, 546-552, 555-561, 568-580, 582-588, 590-600, 609-636 1-217, 231-354, 359-380, 382-433, 435-455, 459-561, 587-607, 613-642 11-27, 74-137, 162-261, 301-335, and 345-451 of SEQ ID NO 158; amino acids 4-28, 47-65, 68-75, 77-85, 94-103, 114-120, 141-150, 157-166, 171-189, 194-215, 236-247, 292-299, 302-322, 382-390, 394-399, 403-415 1-32, 37-155, 157-216, 220-430 277-340, and 384-411 of SEQ ID NO 159; amino acids 10-19, 23-28, 36-48, 62-71, 75-80, 92-99, 111-132, 135-161, 173-183, 190-200, 222-237, 245-259, 261-270, 275-290, 297-304, 309-342, 364-370, 379-389, 395-401, 414-420, 424-433, 440-469, 472-511, 523-537, 543-549 1-82, 90-183, 191-209, 237-257, 260-302, 306-324, 326-344, 351-430, 433-492, 505-557 7-80, 353-383, and 498-536 of SEQ ID NO 160; amino acids 27-35, 37-45, 64-71, 77-87, 111-117, 124-157, 162-184, 207-223, 231-250, 255-284, 291-297, 306-316, 326-338, 352-360, 366-380, 384-393, 408-421, 434-441, 444-450, 456-472, 487-496, 519-531, 539-545, 548-558, 562-567, 575-589, 597-612, 614-620, 622-628, 630-636, 642-649, 657-667, 672-687 1-39, 59-101, 110-128, 131-162, 166-194, 198-257, 271-389, 402-568, 580-649, 655-684 187-256, 496-576, and 659-707 of SEQ ID NO 161; amino acids 12-43, 67-77, 79-95, 108-119, 121-151, 172-225 1-40, 48-228 and 87-124 of SEQ ID NO 162; amino acids 4-10, 12-32, 36-65, 69-95, 108-113 1-67, 79-116 and 22-86 of SEQ ID NO 163; amino acids 4-29, 43-51, 60-80, 82-93, 107-130 1-37, 54-133 and 84-104 of SEQ ID NO 164; amino acids 5-10, 21-40, 60-76, 100-107, 126-134, 138-146, 150-160, 166-178, 192-204 1-110, 123-214 and 43-98 of SEQ ID NO 165; amino acids 4-16, 20-26, 29-37, 43-65, 68-76, 91-108, 111-118, 142-154, 156-213, 229-236, 252-258, 262-269, 277-283 1-129, 139-174, 178-234, 249-289 131-152, and 161-274 of SEQ ID NO 166; amino acids 7-30, 46-52, 71-78, 86-94, 112-122, 131-145, 153-159, 236-241, 251-259, 266-277, 290-298, 304-325, 337-348, 364-377, 379-392, 399-404, 424-442 1-59, 65-89, 96-205, 224-289, 302-332, 354-413, 439-464 50-64, and 131-236 of SEQ ID NO 167; amino acids 4-14, 24-31, 76-84, 99-106, 118-131, 139-150, 154-163, 188-194, 196-202, 217-222, 235-248, 261-267, 281-291, 295-302, 326-334, 357-364, 367-389, 397-410, 412-427, 441-454, 459-468, 484-501, 536-542, 550-572, 586-595, 599-615, 667-676, 684-698, 721-727, 743-752, 759-772, 780-789, 792-809, 817-823, 835-841, 869-875, 882-889, 894-907, 926-938 5-25, 42-105, 111-132, 154-301, 315-344, 354-391, 393-626, 634-719, 739-947 198-214, 305-368, and 454-509 of SEQ ID NO 168; amino acids 4-28, 43-53, 101-110, 112-125, 127-133, 218-228, 246-256, 276-282, 290-296, 306-313, 319-337, 347-354, 356-363, 369-377, 395-403, 421-429, 507-516, 518-528, 536-542, 556-570, 600-615, 617-629 1-156, 215-258, 304-350, 353-384, 388-456, 466-499, 501-575, 577-649 105-166, 461-553, and 579-658 of SEQ ID NO 169; amino acids 4-18, 20-30, 32-44, 49-57, 63-82, 84-90, 102-117, 145-173, 176-190, 193-199, 202-210, 213-223, 231-238, 240-253, 257-263, 270-293, 299-306 1-27, 29-137, 150-313 135-216, and 243-268 of SEQ ID NO 170; amino acids 11-17, 35-51, 63-70, 75-80, 100-110, 113-128, 140-152, 159-175, 196-211, 222-233, 251-262, 264-272, 284-309, 311-319, 328-338, 356-365, 382-398, 404-420, 426-435, 462-469, 479-486, 506-514, 522-529, 532-539, 554-564, 575-584, 595-600, 605-617, 624-638, 662-670, 677-701, 714-734, 736-753, 781-793, 813-825, 836-852, 861-875, 911-916, 961-973, 981-991 1-15, 31-132, 139-242, 247-347, 354-396, 399-423, 425-444, 461-496, 499-640, 656-762, 779-862, 864-895, 908-1008 56-86, 370-395, and 689-745 of SEQ ID NO 171; amino acids 6-23, 36-42, 52-58, 72-79, 102-108, 119-135, 186-194, 199-207, 231-238, 240-253, 263-270, 285-292, 313-321, 333-340, 347-353, 369-376, 399-407, 414-422, 431-437, 450-459, 468-487, 493-499, 506-517, 544-550, 565-571, 575-583, 589-597, 599-619, 682-704, 711-717, 723-729 1-144, 146-235, 238-264, 269-302, 305-626, 629-745 150-212, 391-415, and 460-527 of SEQ ID NO 172; amino acids 13-23, 26-38, 45-52, 54-65, 67-79, 81-94, 114-120, 127-143, 146-162, 173-186, 188-197, 200-207, 214-222, 254-262, 264-270, 278-286, 289-296, 302-310, 318-330, 338-356, 368-380, 421-454, 466-481, 484-493, 509-515, 517-526, 528-536, 551-558, 560-569, 588-593, 600-626, 641-648, 672-695, 702-708 1-28, 32-162, 167-233, 255-282, 284-300, 315-368, 388-427, 464-603, 615-684 113-143, and 509-550 of SEQ ID NO 173; amino acids 23-47, 49-58, 61-67, 88-106, 120-129, 132-142, 145-150, 161-170, 172-185, 199-211, 238-253 5-82, 85-114, 116-159, 162-256 39-137, 151-179, and 182-253 of SEQ ID NO 174; amino acids 4-18, 23-42, 45-79, 83-92, 95-118, 150-157, 167-189, 193-201, 216-222, 225-234, 250-266, 271-282, 284-291, 296-312, 317-324 1-121, 160-188, 198-214, 222-265 65-175, and 244-302 of SEQ ID NO 175; amino acids 4-12, 25-30, 48-70, 76-85, 93-110, 133-139, 151-160, 172-187, 189-212, 214-222, 228-242, 259-280, 286-311, 315-321, 324-360, 371-391, 393-408, 414-424, 427-434, 440-449 1-40, 42-231, 247-452 72-113, 122-159, 206-251, 274-358, and 370-399 of SEQ ID NO 176; amino acids 5-25, 36-42, 64-70, 84-91, 100-114, 116-122, 139-145, 162-176, 186-199, 201-209, 228-234, 241-264, 277-288, 314-336, 356-362 1-79, 94-194, 209-230, 235-351 and 111-265 of SEQ ID NO 177; amino acids 5-15, 39-46, 73-97, 99-125, 134-143, 157-166, 168-187, 195-204, 228-240, 247-270, 278-290 1-46, 57-89, 92-282 161-213, and 248-278 of SEQ ID NO 178; amino acids 56-61, 83-105, 112-128, 133-150, 166-185, 196-205, 215-221, 228-233, 237-246, 251-257, 302-309, 312-323, 325-336, 358-365, 371-382, 394-404 1-15, 29-70, 76-259, 266-286, 298-384, 388-408 11-37, 49-107, 263-297, and 357-405 of SEQ ID NO 179; amino acids 44-49, 71-76, 81-91, 97-103, 121-130, 133-140, 149-174, 184-195, 200-209, 229-236, 238-246, 260-270, 285-292, 305-315, 349-354, 358-363, 373-380, 387-402, 418-431, 442-450, 469-476, 490-516, 523-552, 559-570, 588-596, 608-627, 655-675, 677-686, 704-711, 717-723, 738-753, 760-766 1-126, 130-228, 230-331, 338-377, 380-459, 467-638, 643-699, 712-764 157-255, 519-568, and 583-649 of SEQ ID NO 180; amino acids 10-29, 35-43, 61-80, 88-94, 105-110, 129-138, 148-156, 168-175, 188-193, 195-204, 218-247, 285-293, 323-343, 350-367, 423-453, 467-474, 490-510, 536-565, 588-594, 598-604, 614-632, 643-650, 653-665, 667-674, 682-730, 737-746, 769-776, 784-824, 836-879, 885-898, 912-925, 932-956, 959-975, 979-986, 1002-1027, 1030-1037, 1039-1062, 1088-1095 1-58, 140-266, 282-375, 394-440, 446-1064, 1083-1103 13-107, 137-259, and 827-849 of SEQ ID NO 181; amino acids 13-22, 36-70, 79-90, 98-104, 106-137, 155-167, 178-194, 198-231, 247-256, 274-279, 286-305, 312-317, 322-344, 348-358 9-61, 68-138, 151-197, 200-362 and 293-326 of SEQ ID NO 182; amino acids 20-95, 97-107, 119-129, 138-145, 153-165, 180-196, 211-219, 221-227, 232-241, 248-260, 262-268, 282-289, 304-313, 321-333, 349-358, 371-401, 412-424, 446-454, 474-491, 511-519, 526-534, 537-543, 558-579, 586-592, 604-610 1-117, 134-346, 359-400, 402-489, 510-582 168-228, 346-372, and 556-570 of SEQ ID NO 183; amino acids 4-20, 23-32, 38-47, 55-61, 90-104, 109-122, 124-145, 150-156, 158-164, 173-189, 201-221, 231-236, 242-248, 269-280, 290-307, 320-336, 348-355, 373-387, 407-430, 439-467, 473-480, 501-507, 518-525, 530-545, 548-554, 594-602, 612-623, 625-631, 633-642, 646-653, 658-679 1-356, 369-466, 468-544, 550-571, 582-610, 617-657, 661-698 67-82, 129-300, 437-498, and 540-580 of SEQ ID NO 184; amino acids 4-9, 21-29, 48-53, 55-61, 82-93, 101-114, 144-153, 163-200, 207-214, 216-225, 241-256, 267-275, 282-292, 334-348, 356-372, 390-408, 415-422, 427-436 10-41, 58-78, 85-296, 299-403, 410-444 and 244-355 of SEQ ID NO 185; amino acids 11-18, 21-31, 43-50, 52-66, 77-84, 89-98, 106-111, 121-126, 128-137, 139-150, 152-160, 168-190, 206-216, 218-224, 229-249, 254-262, 264-274, 288-297, 299-325, 335-345 3-20, 33-83, 86-104, 115-160, 168-278, 280-363 and 245-278 of SEQ ID NO 186; amino acids 5-24, 26-39, 46-57, 74-99, 118-124, 143-153, 194-206, 218-224, 246-251, 276-282, 329-337, 345-350, 355-361, 363-370, 372-378, 392-400, 415-423, 436-442, 448-461, 472-481, 509-516, 611-617, 621-627, 638-644, 661-672, 685-691, 694-699, 740-746, 789-809, 839-850, 893-900, 902-908, 914-920, 929-937, 957-967, 984-991, 998-1005, 1012-1035, 1061-1069, 1072-1092, 1106-1111, 1117-1123, 1125-1133, 1135-1149, 1173-1179, 1186-1191, 1223-1233, 1251-1257, 1259-1276, 1285-1297, 1315-1332, 1352-1373, 1383-1389 1-49, 68-107, 113-186, 194-216, 225-288, 292-313, 324-417, 419-454, 492-562, 575-813, 820-930, 955-998, 1009-1074, 1079-1097, 1103-1383 270-365, 467-487, 552-636, 663-742, 829-888, 968-1044, and 1060-1115 of SEQ ID NO 187; amino acids 5-25, 53-59, 87-93, 122-128, 161-166, 174-180, 202-210, 217-223, 231-243, 250-261 2-65, 83-101, 118-133, 171-212, 232-264 47-67, and 134-207 of SEQ ID NO 188; amino acids 4-20, 37-55, 57-64, 73-85, 95-115, 146-154, 156-168, 181-186, 192-199 1-53, 67-128, 140-209 and 10-91 of SEQ ID NO 189; amino acids 5-34, 40-45, 49-67, 90-99, 105-132, 138-144, 160-165, 175-183, 187-193, 215-220, 278-303, 306-320, 323-330, 363-374, 405-429, 441-450, 476-482, 495-501, 515-524, 541-547, 573-582, 608-627, 629-666, 674-681 1-67, 79-97, 100-255, 259-304, 306-343, 348-479, 487-517, 522-579, 581-621, 624-705 28-99, 115-146, and 228-295 of SEQ ID NO 190; amino acids 6-27, 60-66, 68-81, 86-100, 102-111, 126-137, 140-150, 163-171, 189-210, 214-221, 227-234, 263-269, 280-287, 295-302, 309-314, 318-328, 336-343, 350-356, 363-369, 381-390, 408-432, 449-461, 463-498, 506-530, 532-544 1-33, 65-402, 405-565 66-151, and 192-261 of SEQ ID NO 191; amino acids 4-15, 34-42, 83-90, 106-112, 114-120, 124-134, 177-185, 197-203, 210-225, 273-281, 295-301, 318-326, 387-396, 423-428, 444-452, 515-522, 529-535, 559-565, 582-588, 594-604, 628-638, 708-717, 749-756, 798-810, 844-850, 860-866, 875-895, 911-917 1-25, 32-62, 82-139, 147-167, 173-353, 357-484, 486-519, 521-554, 557-687, 701-720, 730-779, 782-899 45-115, and 776-916 of SEQ ID NO 192; amino acids 8-33, 51-59, 73-89, 92-103, 119-141, 149-172, 175-185, 197-202, 211-218, 223-233, 249-258, 268-289, 309-314, 319-333, 340-352, 356-362, 369-393, 403-415, 417-450, 459-483, 493-500, 510-516, 539-549, 557-564 5-297, 329-401, 417-511, 526-567 471-508, and 544-563 of SEQ ID NO 193; amino acids 4-13, 19-34, 39-46, 48-55, 57-66, 76-83, 89-94, 103-116, 123-140, 167-180, 184-196, 206-217, 231-238, 247-255, 257-276, 279-294, 300-328 1-338 and 234-310 of SEQ ID NO 194; amino acids 10-18, 20-32, 34-43, 48-53, 81-88, 104-115, 134-142, 146-154, 159-166, 179-184, 192-200, 205-212, 222-240, 252-260, 267-279, 296-306, 322-337, 351-365, 397-409, 411-420, 436-446, 451-459, 462-469, 471-477 1-98, 102-122, 144-238, 265-334, 347-380, 385-480 138-160, and 365-461 of SEQ ID NO 195; amino acids 4-11, 20-25, 29-45, 60-90, 97-113, 117-131, 136-144, 149-158, 160-186, 198-211, 214-236, 244-290, 307-321, 324-331, 348-356, 365-376, 378-389 1-365, 369-406 and 8-40 of SEQ ID NO 196; amino acids 4-13, 20-25, 33-45, 53-84, 86-99, 101-111, 120-129, 140-169, 175-185, 204-216, 220-226, 229-237, 248-265, 271-281, 300-310, 312-326, 342-348, 350-358, 364-378, 382-403, 405-413, 417-426, 443-449 1-20, 30-68, 73-293, 305-337, 339-441 and 420-464 of SEQ ID NO 197; amino acids 29-44, 72-77, 79-89, 96-102, 118-124, 127-138, 140-167, 174-191, 227-232, 236-244, 252-258, 267-288, 290-298, 317-328, 332-344, 346-365, 385-392, 397-403 1-15, 24-57, 80-95, 121-180, 196-214, 228-307, 318-431 272-326, and 347-429 of SEQ ID NO 198; amino acids 4-37, 39-48, 59-75, 81-103, 139-147, 159-168, 204-226, 233-242, 245-266, 273-280, 286-291, 297-312, 314-321, 338-356, 373-380, 388-395, 405-411, 419-426, 431-472, 474-489, 500-511, 523-529, 532-541, 549-569, 575-585, 593-618, 620-626, 628-644, 650-664, 675-680, 687-695, 701-707, 715-727 1-56, 71-141, 156-250, 260-440, 447-467, 493-525, 531-653, 663-730 54-138, 322-353, 607-644, and 651-709 of SEQ ID NO 199; amino acids 21-39, 45-62, 65-71, 81-93, 118-124, 178-191, 200-205, 209-216, 223-228, 237-248, 252-268, 331-344, 350-364, 366-373, 382-420, 423-439, 457-465, 506-529, 549-555, 594-601, 605-612, 623-631, 645-657, 659-667, 687-692, 695-707, 716-727, 737-743, 749-760, 790-797, 803-810, 822-829

1-73, 76-118, 121-202, 206-254, 262-320, 326-358, 363-609, 617-638, 646-672, 712-728, 742-791, 797-821 13-61, 373-422, and 450-528 of SEQ ID NO 200; amino acids 26-32, 38-58, 60-68, 70-90, 98-111, 116-139, 141-151, 158-169, 173-183, 199-206, 222-262, 270-290, 292-307 1-15, 17-176, 193-320 and 153-242 of SEQ ID NO 201; amino acids 12-37, 48-57, 80-86, 158-165, 171-178, 188-195, 322-331, 344-353, 360-366, 370-389, 396-405 4-77, 158-178, 319-377, 389-408 263-304, and 323-407 of SEQ ID NO 202; amino acids 22-27, 30-36, 45-52, 60-68, 76-110, 112-132, 134-142, 144-150, 163-202, 206-213, 232-239, 254-285, 291-297, 305-314, 324-334, 340-346, 350-356, 364-379, 381-389, 408-414, 427-433, 439-445, 448-454, 458-470, 473-497, 500-507, 516-531, 544-550 16-209, 222-390, 405-529, 537-562 53-83, 218-245, 316-357, and 391-415 of SEQ ID NO 203; amino acids 5-17, 23-33, 48-55, 58-65, 69-76, 89-100, 107-128, 160-191, 197-202, 208-218, 220-238, 259-270, 280-286, 293-321, 326-332, 351-375, 402-425, 446-455 2-39, 45-232, 243-281, 298-384, 386-458 152-241, and 314-353 of SEQ ID NO 204; amino acids 4-14, 17-26, 28-61, 68-90, 104-124, 129-135, 140-146, 148-155, 158-167, 210-236, 238-244, 246-267, 279-292, 298-308, 310-328, 351-364, 368-375, 377-385, 395-402, 408-414, 418-427 13-68, 76-92, 98-172, 174-226, 233-316, 323-342, 346-392, 402-429 2-19, 87-117, 134-234, 242-292, and 376-403 of SEQ ID NO 205; amino acids 4-30, 35-73, 82-114, 116-163, 171-201, 220-238, 240-256 1-261 and 201-228 of SEQ ID NO 206; amino acids 4-9, 18-40, 91-99, 101-110, 112-126, 139-148, 150-175, 185-191, 206-212, 217-223, 243-259, 264-272, 284-290, 296-302, 319-332, 340-364, 369-376, 380-386, 391-408, 426-433, 440-449, 460-467 1-46, 51-83, 90-131, 140-281, 290-311, 315-355, 376-472 105-137, 200-231, and 289-358 of SEQ ID NO 207; amino acids 4-50, 66-84, 92-111, 126-134, 142-149, 159-186, 199-205, 223-228, 241-256, 261-267, 284-295, 336-343, 345-357, 362-368, 387-393, 406-420, 426-433, 445-482, 502-508, 527-534, 539-557, 572-580, 588-609, 624-629, 644-654, 677-696, 735-742, 745-755, 791-801, 806-812, 819-824, 838-844 1-83, 93-120, 123-188, 193-238, 242-571, 583-604, 609-629, 649-729, 733-796, 815-861 302-436, 547-576, and 683-747 of SEQ ID NO 208; amino acids 4-9, 14-27, 29-38, 40-67, 70-81, 85-120, 125-131, 153-174, 222-231, 233-251, 272-295, 297-308, 318-376, 391-403, 416-431, 437-446, 466-503, 509-550 1-140, 170-195, 218-556 115-180, 459-472, and 496-537 of SEQ ID NO 209; amino acids 4-19, 24-30, 32-39, 41-60, 79-85, 102-151, 153-185, 191-211, 217-223, 236-242, 244-251, 258-264, 274-309 1-99, 101-207, 212-248, 251-303 76-100, and 266-286 of SEQ ID NO 210; amino acids 48-71, 100-106, 110-126, 133-139, 143-150, 166-174, 186-199, 212-221, 223-233, 235-259, 261-269, 281-286, 298-304, 312-318, 323-330, 347-360, 376-386, 400-408, 410-418, 436-443, 445-452, 460-467, 477-483, 510-521, 526-537, 564-571, 579-595, 605-652, 667-684, 692-698 40-115, 120-142, 145-240, 258-343, 347-461, 465-507, 526-549, 558-700 57-100, 201-256, 622-665, and 683-699 of SEQ ID NO 211; amino acids 5-22, 28-44, 58-72, 74-80, 84-91, 99-111, 135-140, 142-151, 171-185, 189-198, 208-220, 226-244, 247-253, 260-268, 283-290 1-27, 35-52, 60-143, 165-213, 228-272, 281-313 21-204, and 279-303 of SEQ ID NO 212; amino acids 7-20, 24-31, 41-51, 68-84, 88-102, 108-114, 132-139, 174-184, 200-206, 220-226, 242-248, 250-257, 260-266, 279-289, 300-339, 346-359, 374-383, 420-433 1-15, 21-124, 140-231, 248-370, 379-396, 408-428 160-210, and 221-283 of SEQ ID NO 213; amino acids 4-35, 46-53, 80-94, 122-145, 149-165, 180-186, 193-217, 221-228, 244-251, 254-263, 268-286, 295-306, 327-333, 339-346, 353-359, 375-381, 401-407, 412-419, 432-438, 445-450, 454-467, 484-490 1-250, 254-313, 336-395, 403-479 94-144, and 420-445 of SEQ ID NO 214; amino acids 4-21, 27-61, 63-69, 75-85, 87-131, 143-159, 167-174, 179-186, 189-217, 236-241, 249-278, 283-306, 321-347, 351-361, 363-372, 384-397, 405-414 1-145, 150-216, 236-417 151-177, and 179-250 of SEQ ID NO 215; amino acids 4-21, 32-39, 42-48, 70-82, 93-113, 119-129, 136-142, 149-178, 180-185, 191-204, 210-218, 237-243, 247-255 1-27, 71-115, 131-157, 164-264 82-147, and 166-247 of SEQ ID NO 216; amino acids 4-14, 23-30, 37-46, 54-68, 81-87 1-17, 19-49, 54-79 and 11-32 of SEQ ID NO 217; amino acids 4-24, 27-39, 59-67, 69-82, 99-120, 127-146 1-17, 23-44, 56-149 and 5-149 of SEQ ID NO 218; amino acids 4-26, 44-52, 71-78, 87-98, 110-118, 123-135, 144-151, 154-161, 166-171, 180-193, 201-212, 227-241, 249-257, 259-267, 281-289, 296-312 1-29, 38-243, 251-278, 290-314 and 126-154 of SEQ ID NO 219; amino acids 4-23, 27-42, 60-139, 141-149, 171-183, 187-203, 209-215, 220-247, 249-255, 261-285, 296-313, 316-326, 339-346, 353-374, 379-385, 391-412, 418-428 1-207, 215-324, 326-431 115-195, and 274-381 of SEQ ID NO 220; amino acids 7-21, 31-49, 65-71, 77-85, 94-100, 108-114, 132-155, 162-174, 181-197, 208-221, 228-236, 250-272, 286-293, 304-313, 318-333, 337-342, 347-357, 359-367, 374-383, 385-418, 445-460, 465-473, 498-508, 520-526, 528-535, 537-551, 567-573, 581-588, 604-609, 624-634, 646-654 1-83, 96-114, 123-243, 246-334, 346-424, 435-469, 487-537, 541-567, 578-647 41-153, 434-554, and 593-644 of SEQ ID NO 221; amino acids 5-11, 13-40, 49-56, 75-84, 87-107, 116-121 1-30, 32-65, 68-121 and 85-112 of SEQ ID NO 222; amino acids 5-13, 21-31, 33-46, 49-56, 71-78, 81-92, 98-111, 115-120, 125-134, 148-155, 169-177, 181-186, 195-205, 209-218, 229-238, 245-257, 273-279, 286-306, 308-318, 326-333, 335-342, 345-353, 360-370, 379-387, 398-418, 434-445 3-116, 120-267, 278-339, 341-380, 396-427, 430-450 and 235-250 of SEQ ID NO 223; amino acids 40-50, 74-87, 91-98, 111-120, 127-136, 145-150, 157-174, 179-204, 209-221, 233-246, 252-265, 288-297, 300-316, 326-348, 356-392, 397-408, 414-426, 429-435, 441-459, 473-492, 499-507, 561-570, 604-620 1-17, 19-97, 116-137, 141-383, 386-536, 552-621 20-57, and 546-566 of SEQ ID NO 224; amino acids 9-30, 72-78, 93-108, 185-192, 196-211, 222-228, 232-239, 274-282, 290-299, 305-313, 370-380, 442-451, 500-512, 540-547, 574-590, 596-613, 617-637, 640-655, 657-669, 699-709, 711-722, 736-745, 784-790, 795-801, 803-811, 815-822, 825-831, 841-847, 865-879, 885-892, 918-934, 937-943 1-41, 49-109, 121-164, 182-296, 300-338, 346-368, 371-389, 402-448, 450-514, 520-589, 600-679, 684-992 1-29, 47-98, 190-276, 344-462, 489-527, 541-613, 709-747, and 832-845 of SEQ ID NO 225; amino acids 10-24, 37-44, 53-76, 78-85, 120-127, 134-144, 169-176, 193-201, 219-224, 262-271 1-266 29-151, and 235-272 of SEQ ID NO 226; amino acids 4-21, 34-41, 85-106, 109-119, 156-173, 178-192, 198-211, 216-223, 248-263, 273-287, 315-321, 323-331, 338-343, 355-367, 382-389, 393-402 1-43, 48-111, 117-222, 235-309, 312-362, 366-403 and 18-351 of SEQ ID NO 227; amino acids 15-21, 25-31, 37-42, 47-54, 72-96, 107-118, 121-127, 132-139, 154-161, 167-182, 190-196, 206-215, 224-244, 250-271, 291-301, 304-321, 323-348, 354-362, 370-402, 406-430, 446-451, 468-495, 502-508, 513-528, 530-581, 587-597, 599-606, 608-615, 628-646, 681-686, 688-696, 705-716, 718-742, 746-752, 759-767, 770-797, 805-813, 821-826, 844-858 8-97, 104-158, 178-281, 293-324, 340-432, 434-528, 531-581, 592-663, 666-706, 709-787, 792-809, 844-861 136-200, 266-279, 359-417, 598-663, and 692-740 of SEQ ID NO 228; amino acids 4-9, 24-31, 42-47, 54-62, 65-72, 74-85, 97-112, 120-127, 137-156, 158-166, 197-204, 220-230, 233-244, 246-253, 257-263, 280-286, 294-327, 371-379, 386-407, 410-416, 422-440, 444-450 1-22, 25-68, 70-214, 216-245, 254-282, 292-330, 347-404, 407-470 304-323, and 445-463 of SEQ ID NO 229; amino acids 4-19, 37-43, 54-71, 74-80, 84-90, 98-107, 118-139, 142-158, 167-195, 203-210, 218-228, 230-237, 254-259, 266-277, 300-307, 314-319, 323-337, 340-349 1-38, 52-357 42-177, and 196-324 of SEQ ID NO 230; amino acids 4-18, 49-55, 63-78, 87-109, 112-123, 135-141, 146-156, 171-179, 192-203, 210-219 1-105, 109-235 and 199-233 of SEQ ID NO 231; amino acids 55-61, 70-80, 86-95, 102-128 1-15, 49-139 and 5-19 of SEQ ID NO 232; amino acids 4-24, 28-39, 41-59, 64-88, 96-102, 105-116, 129-136, 151-162, 164-178, 189-202 1-111, 118-205 and 53-182 of SEQ ID NO 233; amino acids 5-29, 40-64, 90-99, 101-112, 114-135, 142-148, 166-183, 190-196, 201-208, 215-227, 233-239, 244-253, 261-269, 273-282, 335-341, 352-359, 370-378, 384-397, 403-416, 432-442, 445-453, 465-474, 489-497, 508-529, 533-542, 547-553, 564-584, 589-604, 617-634, 636-642, 656-669, 702-719, 742-752, 764-771, 774-783, 790-804, 814-821, 823-831, 843-848, 866-874, 879-890, 910-923 1-87, 89-135, 138-166, 169-194, 198-219, 222-240, 243-390, 403-489, 499-571, 575-614, 624-900, 906-924 401-430, 541-680, and 818-854 of SEQ ID NO 234; amino acids 11-22, 29-41, 44-62, 69-75, 80-97, 107-116, 123-130, 136-143, 161-169, 177-182, 190-196, 201-208, 211-223, 234-249, 259-265, 272-279, 297-303, 305-314, 333-341, 344-352, 358-381, 387-400, 417-429, 469-477, 502-512, 536-549, 576-583, 599-607, 611-625, 640-656, 668-696, 710-717, 736-750, 758-765, 772-781, 790-814, 829-846 1-102, 104-139, 158-208, 214-292, 302-391, 397-474, 497-550, 554-856 273-344, 441-500, and 643-690 of SEQ ID NO 235; amino acids 8-14, 28-36, 74-79, 83-100, 105-110, 115-120, 128-139, 147-155, 158-164, 169-177, 182-188, 197-205, 214-221, 233-239, 242-255, 271-279, 288-295, 301-322, 329-343, 345-365, 369-384, 387-396, 405-428, 454-460, 463-475, 486-495, 504-514, 526-533, 539-557, 562-575, 582-596, 638-648, 655-673, 675-683, 710-724, 749-756, 765-776 1-21, 29-216, 235-291, 294-350, 355-521, 535-606, 610-632, 648-745, 747-782 160-194, 350-389, 479-508, and 620-650 of SEQ ID NO 236; amino acids 4-9, 31-37, 43-63, 65-73, 75-95, 103-114, 120-154, 161-172, 176-186, 202-209, 225-258, 273-293, 295-310 22-179, 196-326 and 32-76 of SEQ ID NO 237; amino acids 4-15, 27-41, 47-53, 56-64, 66-73, 75-90, 92-104, 118-153, 157-164, 168-176, 179-209, 218-229, 231-281, 308-332, 335-356, 373-395, 401-415, 423-442, 460-466, 485-501, 506-524, 541-551 1-51, 63-84, 89-120, 130-321, 328-478, 482-504, 509-579 45-82, 315-337, and 351-448 of SEQ ID NO 238; amino acids 11-35, 37-45, 53-62, 66-73, 81-86, 92-100, 105-116, 121-145, 158-182, 186-207, 213-221, 224-233, 246-254, 259-267, 274-279, 283-289, 293-304, 309-317, 332-343, 348-354, 376-382, 384-393 8-54, 60-254, 267-320, 325-348, 375-398 and 54-179 of SEQ ID NO 239; amino acids 23-47, 58-72, 83-92, 109-141, 144-150, 160-172, 183-196, 222-249, 269-278, 300-306, 313-328, 336-348, 377-384 4-77, 84-257, 260-285, 294-384 and 109-205 of SEQ ID NO 240; amino acids 4-21, 26-48, 52-65, 69-77, 79-87, 160-176, 181-191 1-46, 59-98, 127-197 40-123, and 132-158 of SEQ ID NO 241; amino acids 4-12, 16-27, 29-35, 37-49, 58-68, 78-96, 119-126, 132-155, 162-167, 174-179, 186-191, 216-225, 238-244, 249-255, 261-268, 280-290, 316-325, 333-341, 343-349, 375-384, 408-415, 435-444, 449-456, 477-485, 508-516, 522-528, 544-549, 580-586, 588-594, 600-628, 638-644, 662-668, 698-710, 717-727, 744-750, 767-782, 790-797 1-194, 196-239, 246-427, 429-461, 469-591, 594-800 and 186-247 of SEQ ID NO 242; amino acids 4-26, 28-40, 42-49, 57-72, 76-82, 90-144, 148-154, 165-170, 178-183, 209-214, 221-232, 247-257, 280-286, 294-305, 313-323, 329-341, 353-358, 366-384, 386-405, 413-440 1-82, 86-144, 156-202, 206-237, 240-255, 258-276, 287-442 42-141, 224-251, and 292-344 of SEQ ID NO 243; amino acids 5-10, 16-26, 37-43, 51-65, 74-81, 97-103, 114-120, 131-145, 153-167, 175-183, 198-218, 225-231, 237-246, 248-264, 268-280, 286-291, 296-307, 320-326, 339-361, 369-374, 389-396, 425-431, 444-456, 476-495, 497-503, 505-513, 536-542, 546-553, 555-562, 574-586, 595-607, 609-618, 621-629, 636-665, 667-691, 699-719 1-34, 40-84, 109-192, 199-240, 247-352, 391-425, 428-632, 634-665, 667-722 53-152, 172-255, and 540-659 of SEQ ID NO 244; amino acids 4-27, 35-42, 88-94, 114-121, 123-129 1-27, 29-138 and 22-89 of SEQ ID NO 245; amino acids 13-26, 31-37, 44-52, 68-82, 84-96, 104-111, 118-135 6-35, 40-65, 82-139 and 3-102 of SEQ ID NO 246; amino acids 4-11, 29-38, 47-72, 74-90, 93-98, 113-130 1-35, 50-143 and 65-91 of SEQ ID NO 247; amino acids 14-24, 26-34, 39-85, 100-112, 125-135, 151-160, 169-175, 209-217, 221-228, 236-243, 257-268, 305-323, 330-336, 346-351, 354-391, 417-425, 437-442 1-92, 103-134, 148-238, 246-264, 271-300, 307-335, 348-415, 424-448 102-156, 204-246, and 331-384 of SEQ ID NO 248; amino acids 4-10, 18-52, 55-64, 67-76, 82-110, 115-127, 149-158, 165-178, 182-190, 193-206, 215-221, 224-230, 241-248, 266-280, 283-291, 293-299, 334-340, 353-364, 367-382, 390-399, 405-414, 430-443, 462-471, 476-512 1-43, 49-138, 153-169, 172-222, 238-340, 355-372, 385-423, 427-515 126-149, and 225-378 of SEQ ID NO 249; amino acids 8-31, 33-38, 47-55, 65-72, 74-104, 169-181, 197-207, 224-231, 233-241, 243-249, 268-274, 280-287, 316-323, 326-333, 338-344, 401-407, 460-466, 470-476, 479-484, 487-492, 500-512, 519-536, 543-549, 595-608, 615-621, 624-642, 648-654, 730-741, 765-771, 809-816, 819-827, 829-837, 898-914, 949-956, 990-998, 1015-1021, 1044-1049, 1058-1072, 1119-1124, 1200-1206, 1246-1254, 1269-1276, 1292-1298, 1300-1305, 1307-1313, 1326-1332, 1354-1369, 1399-1405, 1419-1426, 1430-1440, 1477-1483, 1497-1505, 1520-1538, 1562-1571, 1584-1596, 1613-1620, 1626-1633, 1668-1693, 1695-1719, 1721-1728, 1756-1774, 1785-1791 1-108, 111-152, 193-212, 218-250, 262-291, 305-440, 450-492, 503-647, 657-730, 732-752, 762-975, 985-1055, 1058-1076, 1082-1099, 1196-1214, 1221-1236, 1243-1263, 1292-1312, 1427-1447, 1495-1648, 1650-1735, 1749-1785 168-451, 560-701, 708-740, 864-924, 967-1147, 1158-1252, 1294-1332, 1342-1396, 1416-1471, 1630-1674, and 1766-1774 of SEQ ID NO 250; amino acids 6-24, 50-57, 82-89, 96-103, 120-128, 130-144, 157-166, 180-188, 216-224, 241-258, 267-273, 276-293, 296-304, 330-339, 389-399, 403-411, 421-428, 432-438, 440-449, 459-466, 493-500, 506-514, 540-562, 568-576, 592-607, 628-634, 636-644, 666-672, 703-710, 729-739, 751-757, 759-767, 770-796, 840-875, 882-888 1-31, 61-100, 107-171, 173-190, 194-294, 298-337, 355-372, 383-529, 538-912 5-35, 41-68, 86-110, 233-359, 365-388, 504-610, and 789-858 of SEQ ID NO 251; amino acids 4-19, 53-61, 65-71, 87-94, 127-138, 154-164, 171-180, 195-200, 229-234, 244-250, 264-273, 321-327, 345-351, 388-402, 409-415, 423-437, 453-462, 464-482, 548-555, 575-580, 601-608, 614-622 5-54, 59-155, 157-231, 233-290, 308-329, 342-423, 429-600, 611-630 4-112, 163-211, 234-366, 384-453, and 549-621 of SEQ ID NO 252; amino acids 5-23, 28-33, 42-49, 69-78, 81-93, 111-119, 149-158, 161-171, 175-181, 189-204, 246-259, 266-272, 279-294, 321-327, 329-347, 349-371, 413-449, 451-477, 479-485, 493-530 1-35, 49-129, 157-213, 220-297, 303-541 112-146, and 174-213 of SEQ ID NO 253; amino acids 8-46, 50-59, 67-78, 85-101, 107-113, 126-141, 160-165, 170-178, 187-193, 195-205, 217-226, 228-243, 257-265, 268-275, 287-292, 299-307, 316-324 1-176, 187-318 44-87, and 150-241 of SEQ ID NO 254; amino acids 12-18, 23-30, 35-50, 54-61, 66-72, 75-81, 87-122, 125-159, 162-173, 178-186, 194-206, 213-236, 254-273, 286-292, 311-322, 324-330, 335-340, 344-353, 362-368, 372-379, 388-397 5-132, 134-247, 252-330, 340-380, 385-400 151-180, and 223-302 of SEQ ID NO 255; amino acids 10-33, 47-67, 88-98, 136-141, 181-192, 197-207, 224-231, 244-250, 259-264, 285-314, 329-335, 356-363, 389-406, 415-425, 428-438, 460-472, 474-482, 514-523, 531-565, 619-624, 632-637, 641-652, 661-675, 683-697, 704-711, 744-763, 775-785, 798-803 1-203, 205-274, 282-373, 383-574, 578-597, 599-761, 773-793 3-64, 320-350, 540-630, and 751-789 of SEQ ID NO 256; amino acids 23-35, 37-43, 45-82, 93-99, 117-123, 133-141, 157-163, 170-180, 191-202, 205-219, 228-248, 253-263, 295-307, 319-327, 330-344, 355-369, 378-390, 408-424, 428-435, 441-450, 453-458, 466-481, 483-508, 534-547, 562-569, 576-584, 599-616, 622-628, 630-643, 645-657, 672-683, 693-718, 725-736, 750-759, 767-773, 784-791, 821-826, 836-844, 853-866, 879-893, 896-926, 932-937, 945-950, 952-958, 981-990, 994-1011, 1015-1028, 1030-1036, 1041-1047, 1050-1068, 1074-1103, 1127-1145, 1159-1181, 1186-1197, 1201-1206, 1214-1235, 1250-1269 1-32, 36-82, 95-126, 129-368, 400-433, 438-760, 762-783, 787-868, 872-986, 991-1032, 1038-1194, 1201-1278 660-691, 704-727, 755-774, and 895-958 of SEQ ID NO 257; amino acids 5-31, 33-39, 41-48, 57-64, 96-102, 110-120, 125-131, 133-144, 147-167, 170-184, 192-213, 223-254, 257-271, 276-290, 298-315, 320-331, 335-352, 373-396, 407-417, 443-452, 474-481, 483-491, 494-517, 525-536 1-28, 32-58, 67-259, 273-339, 351-426, 429-462, 465-512, 526-545 175-201, and 398-477 of SEQ ID NO 258; amino acids 4-10, 12-19, 23-47, 54-63, 70-76, 82-91, 96-134, 136-172, 191-197, 222-234, 238-246, 248-255, 261-267, 272-278, 311-318, 352-362, 364-386, 391-398, 408-413 1-130, 138-185, 193-214, 224-262, 276-353, 362-421 and 87-142 of SEQ ID NO 259; amino acids 4-15, 17-28, 32-38, 45-58, 78-93, 100-106, 117-126, 131-139, 143-162, 171-180, 185-209 3-133, 144-163, 171-201 and 56-203 of SEQ ID NO 260; amino acids 17-33, 36-53, 59-84, 92-97, 100-130, 153-163, 205-211, 218-229, 241-272, 286-295, 298-306, 309-317, 319-331, 338-357, 373-394, 401-418, 424-436, 440-447, 460-481, 510-519, 545-566, 569-590, 599-607, 617-641, 646-651, 653-662 1-174, 176-196, 202-260, 264-322, 325-430, 435-458, 470-543, 547-579, 590-646 17-69, and 140-227 of SEQ ID NO 261; amino acids 4-23, 83-91, 98-104, 120-127, 162-171, 173-181, 200-209, 217-231, 237-255, 272-282, 297-310 1-48, 52-68, 95-124, 130-178, 195-307 and 30-173 of SEQ ID NO 262; amino acids 8-21, 27-49, 51-58, 65-75, 80-86, 103-113, 121-142, 145-159, 166-209, 215-239, 246-252, 258-272, 280-286, 288-307, 312-317, 323-329 3-273, 292-331 and 63-139 of SEQ ID NO 263; amino acids 4-26, 31-38, 56-70, 94-99, 109-140, 163-196, 212-217, 238-248, 252-257, 267-280, 282-290, 324-331, 334-341, 345-355, 367-373, 378-387, 394-401, 411-417, 432-438, 498-522, 529-538 1-49, 55-75, 88-105, 108-150, 159-189, 200-226, 232-258, 279-366, 369-433, 444-469, 478-492, 495-541 and 212-267 of SEQ ID NO 264; amino acids 31-38, 46-68, 84-93, 100-115, 130-135, 154-168, 176-182, 187-202, 217-223, 236-241, 249-255, 261-267, 280-300, 326-346, 359-369, 384-395, 410-421, 433-441, 443-482, 486-498, 506-512, 524-551, 559-569, 572-583, 596-602 1-132, 139-191, 206-243, 248-321, 323-363, 369-410, 412-587, 592-610 289-301, 336-380, and 507-567 of SEQ ID NO 265; amino acids 4-11, 31-42, 50-64, 68-101, 105-112, 120-136, 146-152, 158-169, 178-199, 206-212, 232-237, 247-257, 273-281, 292-303, 305-330, 332-338, 345-359, 361-371, 373-382, 393-400, 403-409, 421-427, 434-451, 453-461, 465-485 1-363, 419-484 and 96-186 of SEQ ID NO 266; amino acids 6-14, 26-37, 39-45, 78-94, 109-123, 127-146, 148-172, 185-207, 211-216, 222-229, 236-251, 255-261, 266-272, 280-303 5-24, 28-47, 52-76, 82-149, 165-185, 191-211, 231-306 34-92, and 239-306 of SEQ ID NO 267; amino acids 4-20, 27-55, 59-89, 96-137, 141-168, 179-199, 216-241, 249-299, 304-311, 341-384, 389-414 1-204, 207-310, 312-440 15-146, 159-182, 296-352, and 393-434 of SEQ ID NO 268; amino acids 6-14, 26-52, 59-72, 76-83, 89-97, 99-112, 130-162, 164-186, 199-209, 241-276, 282-310, 321-336, 343-351, 353-372, 376-385, 392-405, 425-437, 441-447, 470-476, 483-516, 519-529, 545-554, 558-563, 567-582 1-306, 321-385, 390-473, 484-586 and 307-440 of SEQ ID NO 269; amino acids 5-22, 29-35, 66-76, 111-147, 162-185, 187-193, 224-233, 241-248, 253-281, 289-295, 299-316, 329-335, 337-348, 350-356 2-109, 125-161, 168-252, 263-357 4-20, 120-163, and 256-358 of SEQ ID NO 270; amino acids 4-22, 45-53, 74-84, 90-98, 119-133, 162-167 1-28, 46-66, 68-170 17-55, and 68-170 of SEQ ID NO 271; amino acids 4-15, 33-40, 67-78, 85-91, 102-116, 137-143, 153-159, 177-182, 209-216, 218-224, 233-243, 251-258, 286-294, 340-354, 356-363, 371-376, 450-457, 480-486, 507-518, 523-531, 533-548, 552-558, 566-572, 579-599, 612-618, 631-636, 646-659, 662-671, 674-681, 689-703, 717-724, 750-762, 815-822, 827-853, 855-862, 870-886, 895-901, 906-912 1-30, 34-112, 134-233, 242-276, 278-319, 330-364, 369-738, 747-844, 867-887, 891-915 28-296, 382-435, 482-529, and 629-692 of SEQ ID NO 272; amino acids 53-61, 68-82, 94-111, 119-138, 146-152, 154-164, 175-185, 214-223, 233-246, 264-272, 276-289, 304-317, 322-330, 339-345, 352-368, 372-391, 411-417, 426-433, 436-442, 454-476, 479-507, 517-524, 554-567, 571-577, 590-601, 619-647, 660-673, 676-683, 690-698, 708-717, 725-734, 736-743, 766-772, 782-795, 805-816, 818-828, 835-848, 856-867 1-52, 54-107, 123-257, 261-404, 414-578, 589-663, 674-702, 705-744, 752-854, 857-879 335-407, 581-591, and 680-745 of SEQ ID NO 273; amino acids 4-17, 31-38, 79-84, 107-113, 159-169, 171-184, 196-201, 206-218, 227-233, 235-243, 256-264, 268-286, 291-300, 321-331, 364-372, 386-393 1-28, 41-396 and 4-53 of SEQ ID NO 274; amino acids 12-19, 27-44, 51-62, 77-113, 119-140, 165-175, 190-204, 208-230, 237-251, 263-273, 278-283, 291-298, 302-308, 317-328, 352-371, 379-385, 387-400, 405-421, 423-460, 470-477, 484-494, 498-511, 518-541, 550-564, 576-585, 593-601, 631-637 1-235, 237-257, 259-401, 404-418, 430-650 1-15, and 491-583 of SEQ ID NO 275; amino acids 7-43, 47-59, 70-81, 87-94, 103-109, 112-121, 130-140, 160-170, 178-185, 206-217, 221-228, 230-263, 293-301, 335-344, 346-354, 358-372, 386-399, 403-414, 416-430, 459-471, 490-499, 504-515 1-77, 95-138, 147-338, 345-437, 441-538 6-178, 318-353, and 431-536 of SEQ ID NO 276; amino acids 12-29, 39-70, 73-80, 130-139, 143-151, 194-206, 210-216, 220-229, 231-244, 246-255, 287-294, 298-303, 310-317, 331-343, 365-370, 389-400, 417-436, 441-453, 503-523, 550-557, 569-575, 637-644, 661-668, 675-683, 697-703, 717-726, 750-756, 832-838, 859-867, 893-909, 937-944, 1003-1009, 1014-1020, 1042-1049, 1082-1088, 1099-1105, 1125-1133, 1196-1201, 1203-1209, 1244-1250, 1362-1369, 1375-1381, 1405-1419, 1437-1465, 1468-1474, 1482-1493, 1512-1518, 1520-1526, 1529-1536 1-24, 30-257, 269-347, 359-387, 391-405, 412-449, 483-587, 591-864, 871-1025, 1031-1112, 1119-1158, 1173-1212, 1282-1302, 1350-1462, 1479-1519 251-371, 426-456, 620-748, 761-783, 854-959, and 965-1542 of SEQ ID NO 277; amino acids 25-36, 46-57, 66-73, 79-87, 106-115, 124-130, 132-139, 150-165, 170-179, 188-203, 209-220, 236-242, 255-268, 270-281, 286-300, 309-326, 332-351, 359-

373, 412-417 7-55, 72-176, 185-239, 248-316, 330-363, 365-402, 409-444 3-30, 251-274, 278-299, and 303-443 of SEQ ID NO 278; amino acids 4-17, 21-30, 34-41, 46-55, 61-66, 78-88, 103-110, 120-136, 146-153, 155-162, 175-181, 183-191, 195-215, 222-227, 242-248, 250-281, 289-306 1-133, 139-323 and 172-235 of SEQ ID NO 279; amino acids 18-27, 33-61, 63-69, 81-87, 98-109, 112-123, 161-168, 172-177, 191-203, 222-230 1-119, 145-178, 200-234 and 160-194 of SEQ ID NO 280; amino acids 5-18, 20-29, 50-57, 68-83, 87-92, 96-108, 113-124, 129-142, 147-153, 176-186, 198-210, 212-224, 237-244, 270-289, 297-308, 314-327, 333-355, 365-378, 380-389, 391-401, 418-435, 437-446, 464-503, 507-568, 573-601, 606-644, 653-660, 702-720, 726-734, 737-749, 780-787 1-112, 115-170, 175-195, 253-355, 363-379, 384-457, 461-679, 681-723, 746-781 86-123, 283-358, 646-684, and 705-796 of SEQ ID NO 281; amino acids 4-11, 40-48, 60-69, 84-92, 113-130, 137-145, 147-164, 194-200, 230-237, 284-290, 329-335, 345-351, 389-409, 421-427, 447-453, 472-484, 486-494, 515-524, 538-544, 563-568, 581-590, 596-610, 653-662, 665-671, 689-703, 710-720, 746-760, 773-779 1-23, 39-74, 80-112, 120-180, 187-293, 303-317, 324-371, 389-438, 441-619, 635-677, 682-710, 721-782 146-239, and 527-577 of SEQ ID NO 282; amino acids 4-21, 34-40, 48-54, 61-72, 82-88, 135-155, 173-178 1-164, 170-184 and 73-113 of SEQ ID NO 283; amino acids 4-38, 49-60, 89-98, 105-113, 117-133, 137-146, 149-174, 186-207, 230-236, 247-260, 266-281, 307-315, 317-332, 349-354, 361-369, 391-400, 413-419, 427-433, 443-451, 462-472, 484-491, 495-512, 516-522, 531-538, 541-551, 556-564, 573-597, 603-612 1-81, 87-118, 141-176, 180-336, 359-460, 478-501, 505-522, 549-615 465-549, and 552-599 of SEQ ID NO 284; amino acids 13-20, 28-34, 37-44, 49-57, 61-68, 77-83, 85-109, 118-140, 148-162, 169-175, 180-198, 210-216, 236-270, 276-304, 330-337, 341-349, 364-371, 380-386, 388-406, 412-417, 422-437, 461-514, 518-525, 530-563 7-67, 73-105, 110-372, 383-405, 419-438, 441-502, 514-543, 552-571 96-153, 175-214, 246-338, and 370-413 of SEQ ID NO 285; amino acids 7-26, 38-46, 60-68, 80-86, 99-105, 180-188 1-36, 59-97 and 11-146 of SEQ ID NO 286; amino acids 15-37, 43-52, 59-69, 71-85, 89-100, 115-137, 154-174, 185-192, 194-204, 225-233, 250-259, 269-280, 296-318, 323-329, 335-341, 343-365, 370-378, 385-391 4-31, 44-83, 87-110, 128-216, 235-264, 271-312, 344-397 99-123, 259-275, and 306-358 of SEQ ID NO 287; amino acids 6-16, 18-28, 31-50, 52-58, 89-98, 122-128, 133-141, 151-164, 172-183, 185-201, 222-232, 234-242, 244-275 1-37, 42-70, 74-158, 172-210, 217-275 and 183-275 of SEQ ID NO 288; amino acids 5-12, 14-47, 53-65, 75-81, 89-97, 113-126, 132-145, 162-168, 172-193, 201-209, 238-255, 260-271 18-38, 68-109, 130-155, 163-218, 222-269 and 81-139 of SEQ ID NO 289; amino acids 13-23, 39-53, 92-99, 156-176, 184-192, 202-212, 220-228, 236-243, 248-263, 265-272, 279-287, 301-310, 327-333, 347-363, 365-373, 377-382, 387-403, 408-421, 427-434, 465-473, 507-525, 529-534, 540-552, 566-572, 594-600, 621-628, 655-661, 672-678, 694-709, 716-729, 734-761, 765-776, 778-787, 803-812, 822-831, 840-850, 853-862, 864-883, 916-929, 946-951 1-22, 24-55, 57-85, 88-108, 110-149, 165-193, 197-271, 276-364, 377-409, 414-448, 454-575, 583-612, 614-665, 673-788, 800-870, 873-893, 900-930 9-62, 123-140, and 336-400 of SEQ ID NO 290; amino acids 9-24, 32-46, 66-76, 84-111, 113-130, 137-158, 169-175, 203-210, 213-225, 227-235, 237-243, 249-254, 262-267, 276-287, 296-304, 315-329 1-59, 84-296, 269-297, 312-332 15-96, and 271-318 of SEQ ID NO 291; amino acids 26-32, 66-73, 86-101, 123-133, 139-150, 156-162, 164-170, 186-192, 204-213, 221-229, 237-255, 258-266, 299-304, 308-313, 344-353, 367-384, 407-413, 432-448, 451-463, 466-483, 495-502, 516-528, 539-545, 547-557, 559-568, 570-579, 602-609, 611-617, 643-655, 675-681, 692-705, 722-734, 736-779, 786-806, 813-821, 839-872, 913-927, 939-946, 951-969, 991-1008, 1056-1087, 1104-1109, 1114-1126, 1146-1163, 1177-1183, 1192-1199, 1207-1213, 1224-1234, 1258-1264, 1271-1282, 1306-1319, 1323-1331, 1352-1359, 1374-1380, 1382-1392, 1415-1423, 1434-1447, 1455-1465, 1467-1474, 1485-1491, 1495-1504 7-70, 77-114, 116-176, 198-328, 346-398, 410-477, 493-561, 563-592, 600-655, 664-684, 689-709, 724-768, 772-832, 853-934, 945-1018, 1026-1115, 1128-1255, 1273-1367, 1384-1430, 1435-1510 33-87, 275-390, 524-542, and 1025-1065 of SEQ ID NO 292; amino acids 36-42, 45-50, 59-87, 95-102, 110-116, 119-143, 147-156, 171-212, 217-227, 241-251, 269-278, 283-292, 300-309, 318-325, 329-341, 345-354, 388-394, 404-410, 463-469, 491-502, 510-538, 549-555, 599-611, 629-643, 652-666, 670-676, 695-702, 712-727 19-57, 63-126, 134-263, 295-332, 342-363, 366-424, 432-461, 472-727 146-215, 270-425, and 535-609 of SEQ ID NO 293; amino acids 33-39, 45-61, 63-73, 81-97, 108-133, 195-208, 213-228, 232-241, 249-256, 259-271, 280-290, 313-323, 328-343, 352-365, 368-375, 386-398, 410-418, 420-429, 441-448, 461-474, 481-490, 497-518, 531-537, 542-554 41-86, 106-130, 135-153, 179-228, 235-250, 265-353, 359-383, 388-439, 455-519, 526-557 and 79-137 of SEQ ID NO 294; amino acids 16-23, 31-77, 97-110, 120-133, 143-150, 156-163, 168-178, 181-209, 211-217, 219-226, 234-247, 257-264, 276-289 13-81, 94-158, 177-205, 208-292 67-87, and 220-258 of SEQ ID NO 295; amino acids 12-17, 45-62, 74-93, 111-121, 124-138, 163-171, 185-205, 213-221, 248-255, 262-268, 270-277, 280-301, 303-317, 325-332, 341-351, 362-370, 372-393, 440-446, 452-458 1-127, 140-454 22-55, 88-152, and 289-345 of SEQ ID NO 296; amino acids 16-22, 29-42, 44-57, 77-83, 93-98, 111-117, 123-130, 141-150, 163-173, 180-187, 198-220, 232-255, 261-267, 279-284, 364-375, 380-385, 400-417, 424-430, 439-446, 454-459, 465-471, 484-491, 499-511, 528-535 23-69, 75-90, 103-140, 159-308, 322-473, 475-513, 519-538 209-271, 320-379, 400-442, and 513-556 of SEQ ID NO 297; amino acids 32-37, 49-56, 73-80, 95-101, 103-118, 129-139, 186-198, 208-214, 222-231, 244-251 1-20, 55-86, 92-118, 144-228, 231-249 and 167-245 of SEQ ID NO 298; amino acids 4-11, 15-34, 48-66, 72-78, 98-109, 118-139, 141-149, 171-177, 182-188, 195-203, 205-222, 252-258, 281-287, 292-298, 340-348, 388-394, 403-409, 447-467, 479-485, 505-511, 530-542, 544-552, 573-582, 589-594, 596-607, 621-626, 638-648, 654-668, 673-680, 682-690, 708-721, 723-729, 747-757, 769-778, 786-799, 802-818, 831-837 1-31, 39-105, 109-160, 168-238, 245-263, 273-351, 361-375, 382-429, 447-605, 613-627, 634-692, 707-768, 782-806 21-48, 60-105, 201-215, and 545-633 of SEQ ID NO 299; amino acids 10-17, 44-54, 56-63, 69-81, 112-119, 125-134, 162-168, 171-177, 181-187, 206-221, 226-247, 256-263, 265-296, 299-305, 317-332, 335-346 1-45, 47-86, 109-127, 133-162, 168-190, 197-349 51-192, and 261-281 of SEQ ID NO 300; amino acids 5-35, 37-57, 59-69, 100-106, 109-116, 124-130, 137-142, 147-154, 169-180, 190-197, 225-231, 237-244, 251-258, 261-271, 274-280, 287-310, 331-340, 360-366, 378-387, 407-415, 419-424, 441-452 1-87, 90-125, 136-154, 169-277, 279-337, 348-379, 390-463 and 271-450 of SEQ ID NO 301; amino acids 6-31, 41-47, 54-73, 76-151, 162-177, 187-201, 211-219, 224-251, 257-268, 272-278, 289-311 1-199, 207-320 and 69-97 of SEQ ID NO 302; amino acids 4-11, 29-41, 46-83, 90-110, 118-130, 141-205 1-19, 21-218 and 93-163 of SEQ ID NO 303; amino acids 12-19, 37-42, 64-71, 101-107, 109-121, 135-146, 159-167, 173-181, 186-194, 215-220, 233-241, 258-264, 269-275, 277-287, 292-299, 304-325, 330-341, 345-355, 367-399, 420-427, 433-442, 470-476, 498-505, 529-535, 555-561, 565-572, 586-594, 596-606, 621-626 1-30, 42-143, 158-181, 211-229, 237-264, 289-325, 330-355, 358-446, 450-553, 585-605 and 507-598 of SEQ ID NO 304; amino acids 4-16, 37-49, 53-62, 94-108, 112-122, 124-131, 136-145, 150-160, 168-179, 187-203, 205-231, 233-247, 256-269, 274-283, 291-299, 307-316, 321-331, 344-351, 361-384, 387-392 1-71, 74-192, 202-255, 268-300, 306-396 31-66, and 117-140 of SEQ ID NO 305; amino acids 4-13, 17-24, 34-43, 45-52, 62-70, 77-130, 136-145, 153-170, 177-193, 214-255, 257-269, 287-298, 317-328, 356-361, 376-391, 402-416, 420-432, 434-443, 447-457, 460-476 1-51, 53-93, 98-198, 210-288, 291-311, 318-393, 398-455 262-294, and 428-474 of SEQ ID NO 306; amino acids 14-29, 64-76, 80-89, 98-108, 118-132, 138-146, 152-158, 178-184, 202-214, 216-226, 233-251, 254-266, 288-295, 301-311, 313-335, 337-346, 348-361, 379-385, 414-426, 433-443, 451-467, 485-492, 523-528, 533-551, 566-572 1-88, 115-196, 198-575 37-179, and 309-487 of SEQ ID NO 307; amino acids 4-9, 39-54, 70-80, 92-99, 101-113, 121-145, 159-165, 170-176, 179-192, 209-215, 220-226, 233-239, 253-260, 284-292, 313-318, 321-354, 364-387, 395-408, 423-429, 431-441, 446-451, 467-475, 491-498, 501-513, 535-540, 552-557, 570-595, 619-632, 642-650, 656-665, 673-688, 710-721, 729-739, 752-761, 764-779, 790-812, 818-823, 832-849, 857-893, 898-905, 908-923, 925-938, 940-947 1-39, 71-95, 99-146, 150-300, 311-366, 378-424, 426-625, 635-688, 707-746, 749-823, 829-856, 869-886, 895-946 8-35, 181-217, 236-329, and 491-566 of SEQ ID NO 308; amino acids 12-29, 39-70, 73-80, 113-118, 133-139, 143-149, 194-205, 210-216, 223-229, 231-244, 286-294, 297-303, 310-317, 331-343, 365-370, 389-400, 417-427, 431-439, 481-493, 495-501, 508-515, 539-547, 560-566, 578-589, 625-632, 644-652, 668-681, 708-725, 739-749, 757-769, 784-796, 799-805, 853-859, 878-884, 887-893, 922-929, 1002-1008, 1054-1059, 1069-1077, 1115-1125, 1176-1181, 1186-1191, 1195-1201, 1235-1243, 1264-1269, 1283-1289, 1312-1318, 1325-1331, 1344-1349, 1355-1367, 1387-1393, 1395-1415, 1418-1424, 1432-1443, 1462-1468, 1470-1476, 1479-1486 1-24, 30-257, 269-347, 359-387, 391-405, 412-453, 461-534, 536-568, 575-670, 674-853, 855-929, 931-1013, 1025-1086, 1111-1148, 1183-1203, 1208-1226, 1232-1248, 1265-1284, 1293-1334, 1340-1412, 1429-1469 15-82, 302-383, 542-619, 827-905, 945-1036, 1045-1297, and 1304-1450 of SEQ ID NO 309; amino acids 9-33, 36-55, 63-69, 73-82, 89-95, 104-112, 114-126, 177-184, 187-193, 196-204 1-43, 50-160, 170-207 and 128-185 of SEQ ID NO 310; amino acids 5-16, 22-29, 33-48, 74-80, 83-90, 96-104, 115-121, 125-135, 142-155, 160-168, 171-178, 193-201, 211-217, 226-244, 250-258, 263-269, 272-279, 284-292, 300-325, 339-348, 358-364, 368-376, 391-397, 400-412, 430-439, 476-490, 493-505, 522-534, 540-546, 562-576, 580-586, 591-598, 602-608, 623-628, 635-646, 651-656 1-15, 30-66, 72-113, 121-332, 338-412, 429-543, 550-579, 581-659 107-118, 126-187, 266-361, and 364-427 of SEQ ID NO 311; amino acids 5-18, 22-47, 49-54, 69-75, 77-83, 87-93, 97-111, 121-133, 135-145, 147-154, 159-178, 197-204, 209-215, 229-238, 242-262, 269-276, 282-296, 298-306 2-45, 48-83, 112-152, 154-185, 190-309 33-107, 172-202, and 235-305 of SEQ ID NO 312.

In one embodiment the antigen further consists of
a) 1 to 50 additional amino acid residue(s), preferably 1 to 40, more preferably 1 to 30, even more preferably at most 1 to 25, still more preferably at most 1 to 10, most preferably 1, 2, 3, 4 or 5 additional amino acid residue(s); and/or b) at least one amino acid residue heterologous to the core amino acid sequence.

Said additional amino acid residue(s) are further defined above.

In another embodiment said amino acid residue(s) is/are flanking the core amino acid sequence N-terminally, C-terminally, or N- and C-terminally.

In an embodiment of the invention the antigen comprises at least 2, at least 3, at least 4, at least 5 or at least 6 core amino acid sequences as defined above.

The problem underlying the present invention is solved in another aspect by a process for producing an antigen, or an active fragment or an active variant thereof, as defined in the present invention, comprising expressing the nucleic acid molecule as defined above.

The present invention further relates to a process for producing a cell which expresses an antigen, or an active fragment or an active variant thereof, as defined above, comprising transforming or transfecting a suitable host cell with the vector as defined above.

In an embodiment, the antigen, or the active fragment or the active variant thereof, is isolated from nontypable *Haemophilus influenzae*.

The problem underlying the present invention is solved in another aspect by a pharmaceutical composition, preferably a vaccine, comprising an antigen, or an active fragment or an active variant thereof, as defined above, or a nucleic acid molecule as defined above, or a vector as defined above.

Another aspect of the present invention provides a pharmaceutical composition, preferably a vaccine, comprising an antigen, or an active fragment or an active variant thereof, as defined above, or a nucleic acid molecule as defined above, or a vector as defined above, for the treatment or prevention of an infection with nontypable *Haemophilus influenzae*.

In a preferred embodiment the pharmaceutical composition of the present invention further comprises an immunostimulatory substance, preferably polycationic polymers, especially polycationic peptides, immunostimulatory oligodeoxynucleotides (ODNs), especially Oligo(dIdC)$_{13}$ (SEQ ID NO: 627), peptides containing at least two LysLeuLys motifs, especially KLKLLLLLKLK (SEQ ID NO: 628), neuroactive compounds, especially human growth hormone, alum, Freund's complete or incomplete adjuvants, or combinations thereof.

In a more preferred embodiment of the pharmaceutical composition of the present invention the immunostimulatory substance is a combination of either a polycationic polymer and immunostimulatory deoxynucleotides, or of a peptide containing at least two LysLeuLys motifs and immunostimulatory deoxynucleotides, preferably a combination of KLKLLLLLKLK (SEQ ID NO: 628) and Oligo(dIdC)$_{13}$ (SEQ ID NO: 627).

In a still more preferred embodiment of the pharmaceutical composition of the present invention the polycationic polymer is a polycationic peptide, especially polyarginine.

Still another aspect of the present invention provides an antigen, or an active fragment or an active variant thereof, as defined above, or a nucleic acid molecule as defined above, or a vector as defined above for the treatment or prevention of an infection with nontypable *Haemophilus influenzae*.

Another preferred embodiment of the invention relates to the use of an antigen, an active fragment or an active variant thereof as defined above, or a nucleic acid molecule as defined above, or a vector as defined above for the preparation of a pharmaceutical composition, especially for the preparation of a vaccine, for treating or preventing infections with nontypable *Haemophilus influenzae*.

The problem underlying the present invention is solved in a further aspect by an antibody, or at least an effective part thereof, which binds to at least a selective part of an antigen or a fragment thereof, preferably an active fragment thereof, or a variant thereof, preferably an active variant thereof, as defined above.

In a preferred embodiment the antibody is a monoclonal antibody.

In another preferred embodiment said effective part comprises a Fab fragment, a F(ab) fragment, a F(ab) N fragment, a F (ab)$_2$ fragment or a F$_v$ fragment.

In still another embodiment of the invention the antibody is a chimeric antibody.

In yet another embodiment the antibody is a humanized antibody.

In a further embodiment the antibody is an IgA or IgG antibody.

Another aspect of the invention relates to a hybridoma cell line, which produces an antibody as defined above.

The problem underlying the present invention is furthermore solved by a method for producing an antibody as defined above, characterized by the following steps:
 a) initiating an immune response in a non-human animal by administering an antigen, or an active fragment or an active variant thereof, as defined above, to said animal,
 b) removing an antibody containing body fluid from said animal, and
 c) producing the antibody by subjecting said antibody containing body fluid to further purification steps.

The invention further relates to a method for producing an antibody as defined above, characterized by the following steps:
 a) initiating an immune response in a non-human animal by administering an antigen or an active fragment or an active variant thereof, as defined above, to said animal,
 b) removing the spleen or spleen cells from said animal,
 c) producing hybridoma cells of said spleen or spleen cells,
 d) selecting and cloning hybridoma cells specific for said antigen or for said active fragment or for said active variant thereof,
 e) producing the antibody by cultivation of said cloned hybridoma cells, and
 f) optionally conducting further purification steps.

Another aspect of the present invention is related to a pharmaceutical composition comprising an antibody as specified above.

Still another aspect relates to an antibody as defined above or a pharmaceutical composition comprising an antibody as defined above for the treatment or prevention of an infection with nontypable *Haemophilus influenzae*.

The problem underlying the present invention is solved in another aspect by the use of an antibody as defined above for the preparation of a pharmaceutical composition for treating or preventing infections with nontypable *Haemophilus influenzae*.

According to another aspect the present invention provides an antagonist, which binds or is capable of binding to an antigen, or an active fragment or active variant thereof as disclosed in the present invention. According to a still further aspect the antagonist according to the present invention is an antagonist which is capable of reducing or inhibiting the interaction activity of an antigen, or an active fragment thereof or an active variant thereof, according to the present invention to its interaction partner. Such interaction partner is, in a preferred embodiment, an antibody or a receptor, preferably a physiological receptor, of said antigen, or an active fragment thereof or an active variant thereof.

According to another aspect the present invention provides a method for identifying an antagonist capable of binding to an antigen or an active fragment or an active variant thereof, as defined above, comprising:
 a) contacting an isolated or immobilized antigen or an active fragment or an active variant thereof, as defined above, with a candidate antagonist under conditions to permit binding of said candidate antagonist to said antigen, or an active fragment or active variant thereof, in the presence of a component capable of providing a detectable signal in response to the binding of the candidate antagonist to said antigen, or an active fragment or an active variant thereof; and
 b) detecting the presence or absence of a signal generated in response to the binding of the antagonist to said antigen, or an active fragment or active variant thereof.

The problem underlying the present invention is further solved by a method for identifying an antagonist capable of reducing or inhibiting the interaction activity of an antigen or an active fragment or an active variant thereof, as defined above, to its interaction partner comprising:
 a) providing an antigen, or an active fragment or active variant thereof, as defined above,
 b) providing an interaction partner to said antigen, or said active fragment or active variant thereof, especially an antibody as defined above,
 c) allowing interaction of said antigen or said active fragment or active variant thereof, to said interaction partner to form an interaction complex,
 d) providing a candidate antagonist,
 e) allowing a competition reaction to occur between the candidate antagonist and the interaction complex,
 f) determining whether the candidate antagonist inhibits or reduces the interaction activities of the antigen, or the active fragment or the active variant thereof, with the interaction partner.

The present invention further relates to the use of any of the antigens, or an active fragment or an active variant thereof, as defined above, for the isolation and/or purification and/or identification of an interaction partner of said antigen, or said active fragment or active variant thereof.

Another aspect of the present invention relates to a method for diagnosing an infection with a nontypable *Haemophilus influenzae* organism comprising the steps of
 a) contacting a sample obtained from a subject with an antigen, or an active fragment or active variant thereof, as defined above; and
 b) detecting the presence of an antibody against said nontypable *Haemophilus influenzae* organism in the sample.

According to an embodiment of said method, the presence of one or more antibodies against said nontypable *Haemophilus influenzae* organism is indicative for the nontypable *Haemophilus influenzae* infection.

In another embodiment of said method the antibody is an IgA or IgG antibody.

In yet another aspect the present invention provides a method for diagnosing an infection with a nontypable *Haemophilus influenzae* organism comprising the steps of
 a) contacting a sample obtained from a subject with the antibody as defined above; and
 b) detecting the presence of an antigen of said nontypable *Haemophilus influenzae* organism in the sample.

In an embodiment of said method the antigen of said nontypable *Haemophilus influenzae* organism is an antigen, or an active fragment or an active variant thereof, as defined above.

According to an embodiment of said method, the presence of one or more antigens of said nontypable *Haemophilus influenzae* organism is indicative for the nontypable *Haemophilus influenzae* infection.

In another embodiment of said method the antibody is an IgA or IgG antibody.

Still another aspect relates to a method for diagnosing an infection with a nontypable *Haemophilus influenzae* organism comprising the steps of:
a) contacting a sample obtained from a subject with a primer or a probe specific for a nucleic acid molecule, or a fragment thereof, as defined above; and
b) detecting the presence of such nucleic acid molecule or fragment thereof in the sample.

According to an embodiment of said method, the presence of one or more of said nucleic acid molecules or fragments thereof is indicative for the nontypable *Haemophilus influenzae* infection.

The present invention also provides a process for in vitro diagnosing a disease related to expression of an antigen or a fragment thereof according to the present invention comprising determining the presence of a nucleic acid sequence encoding said antigen or fragment thereof according to the present invention or determining the presence of the antigen or fragment thereof according to the present invention.

In an embodiment of any of the above described methods for diagnosing an infection with a nontypable *Haemophilus influenzae* organism, the nontypable *Haemophilus influenzae* organism is a pathogenic nontypable *Haemophilus influenzae* organism.

Moreover, the present invention provides the use of an antigen, or a fragment or a variant thereof, as defined in the present invention for the generation of a peptide binding to said antigen, or a fragment thereof or a variant thereof, wherein the peptide is an anticaline.

Moreover, the present invention provides the use of an antigen, or an active fragment or active variant thereof, as defined above, for the preparation of a functional nucleic acid, wherein the functional nucleic acid is selected from the group consisting of aptamers and spiegelmers.

In another aspect, the present invention provides the use of a nucleic acid molecule as defined above for the preparation of a functional ribonucleic acid, wherein the functional ribonucleic acid is selected from the group consisting of ribozymes, antisense nucleic acids and siRNA.

The problem underlying the present invention is further solved by a method for the treatment of a nontypable *Haemophilus influenzae* infection in an animal or human preferably in need thereof, comprising the step of administering to said animal or human a therapeutically effective amount of an antigen, or an active fragment or an active variant thereof, or a nucleic acid molecule, or a vector, or an antibody or a pharmaceutical composition as defined in any of the preceding aspects.

The problem underlying the present invention is solved in another aspect by a method for immunizing an animal or human against infection with a nontypable *Haemophilus influenzae* organism, comprising the step of administering to said animal or human an effective amount of the antigen, or an active fragment or active variant thereof, as defined above, or the nucleic acid molecule as defined above, or a vector as defined above, or an antibody as defined above, or a pharmaceutical composition as defined above, wherein the effective amount is suitable to elicit an immune response in said animal or human.

The problem underlying the present invention is solved in yet another aspect by a method for stimulating an immune response in an animal or human against a nontypable *Haemophilus influenzae* organism, comprising the step of administering to said animal or human an effective amount of the antigen, or an active fragment or an active variant thereof, as defined above, or of the nucleic acid molecule as defined above or of a vector as defined above, or an antibody as defined above, or a pharmaceutical composition as defined above, wherein the effective amount is suitable to stimulate the immune response in said animal or human.

It is within the present invention that the various methods and uses, respectively, where an antigen as defined in the present invention is used, can also be performed or practiced using a fragment of such antigen, preferably an active fragment thereof, or a variant of such antigen, preferably an active variant thereof, each as preferably described herein. It is also within the present invention that the various kinds of compounds disclosed herein as interacting with or targeting the antigen according to the present invention, can additionally or alternatively interact with or target the active fragment or active variant of said antigen.

It is also within the present invention that each and any method in the practice of which an antibody is used, can, in principle, also be practiced when instead of the antibody the anticalines or the functional nucleic acids as defined herein are used, whereby it is preferred that such functional nucleic acid is selected from the group consisting of aptamers and spiegelmers. This applies equally to the various uses of the present application.

In a preferred embodiment a fragment of an antigen as disclosed herein is a part of such antigen which exhibits at least one feature of such antigen. Preferably such feature is a feature selected from the group consisting of suitability for the treatment of infections, immunization of an animal including human, and/or stimulation of an immune response in an animal including human.

It is also within the present invention that any disclosure made herein in relation to nontypable *Haemophilus influenzae*.

The terms "polypeptide", "peptide", "protein" or "antigen" are used interchangeably throughout the present specification and refer in a comprehensive manner to the antigen according to the present invention, including each and any variant, fragment, analogue or derivative thereof, particularly as described herein. Insofar, whenever the term polypeptide, peptide, protein or antigen is used herein, and if not explicitly stated otherwise, the respective disclosure is also made for or in relation to any antigen according to the present invention, including each and any variant, fragment, analogue or derivative thereof, particularly as described herein. Also it is to be understood that any use or aspect described in connection with any of the above mentioned compounds covered by the term polypeptide, peptide, protein or antigen according to the present invention shall be applicable also to each and any other of the above mentioned compounds covered by the term polypeptide, peptide, protein or antigen according to the present invention.

The present invention advantageously provides an efficient, relevant and comprehensive set of isolated nucleic acid molecules and antigens encoded by them, including the active fragments and the active variants thereof, using an antibody preparation from multiple human plasma pools and surface expression libraries derived from the genome of nontypable *Haemophilus influenzae*. Thus, the present invention fulfils a widely felt demand for nontypable *Haemophilus influenzae* antigens, vaccines, diagnostics and products useful in procedures for preparing antibodies and for identifying compounds effective against infections caused by pathogenic nontypable *Haemophilus influenzae* species.

An effective vaccine should be composed of proteins or polypeptides, which are expressed by all strains and are able to induce high affinity, abundant antibodies against cell surface components of said pathogenic nontypable *Haemophilus influenzae*. The antibodies should be IgG1 and/or IgG3 for opsonisation, any IgG subtype, and/or IgA for neutralisation of adherence and toxin action.

Nontypable *Haemophilus influenzae* infects the host via the mucosal epithelia of the respiratory tract and mucosal immunity is therefore believed to be important to control infection. IgA is the primary immune globuline (Ig) isotype induced at mucosal sites and is thought to mediate defense functions at these sites.

A chemically defined vaccine must be definitely superior compared to a whole cell vaccine (attenuated or killed), since components of said pathogenic nontypable *Haemophilus influenzae*, which cross-react with human tissues or inhibit opsonisation can be eliminated, and the individual polypeptides inducing protective antibodies and/or a protective immune response can be selected.

In a preferred embodiment of the present invention, the nucleic acid molecules exhibit 70% identity over their entire length to a nucleotide sequence set forth in SEQ ID NOs 636 to 641, 643, 646, 648 or 1 to 156. More preferred are nucleic acids that comprise a region that is at least 80% or at least 85% identical over their entire length to a nucleic acid molecule set forth in SEQ ID NOs 636 to 641, 643, 646, 648 or 1 to 156. In this regard, nucleic acid molecules, which are at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids, which encode antigens or fragments thereof (polypeptides), which retain substantially the same biological function or activity as the mature polypeptide set forth in the SEQ ID NOs 656 to 661, 663, 666, 668 or 157 to 312. It is also within the present invention that the nucleic acid molecules according to the present invention are coding for a protein which is preferably an antigen. Still further it is within the present invention, that the molecules defined by SEQ ID NOs 656 to 661, 663, 666, 668 or 157 to 312 are proteins, which are preferably antigens.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While a number of methods exist to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package (Devereux, J. et al., 1984), BLASTP, BLASTN, and FASTA (Altschul, S. et al., 1990).

As a second alternative to the nucleic acid molecules described herein by reference to SEQ ID NOs 636 to 641, 643, 646, 648 or 1 to 156, the description of which is also referred to herein as first alternative, the nucleic acid molecules according to the present invention can also be nucleic acid molecules, which are at least essentially complementary to the nucleic acids described in accordance with the first alternative herein. It will be acknowledged by the ones skilled in the art that an individual nucleic acid molecule is at least essentially complementary to another individual nucleic acid molecule. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. Such higher percentage includes 91, 92, 93, 94, 95, 96, 97, 98, 99 and 100%, whereby such definition is applicable to each aspect of the present application where this kind of terminology is used. It is to be noted that a percentage of 70% matching bases is considered as homology and the hybridisation having this extent of matching base pairs is considered as stringent. Hybridisation conditions for this kind of stringent hybridisation may be taken from Current Protocols in Molecular Biology (John Wiley and Sons, Inc., 1987). More particularly, the hybridisation conditions can be as follows:

Hybridisation performed e.g. in 5×SSPE, 5×Denhardt's reagent, 0.1% SDS, 100 g/mL sheared DNA at 68° C.

Moderate stringency wash in 0.2×SSC, 0.1% SDS at 42° C.

High stringency wash in 0.1×SSC, 0.1% SDS at 68° C.

Genomic DNA with a GC content of 50% has an approximate $T_M$ of 96° C. For 1% mismatch, the $T_M$ is reduced by approximately 1° C.

In addition, any of the further hybridisation conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for active fragments or active variants of a given antigen, as long as the fragments or variants encode an antigen being suitable to be used such that the same effect can be obtained as if the full-length antigen was used. Preferably, such antigens or active fragments or active variants thereof may be used in a vaccination application, e.g. as an active or passive vaccine.

As a third alternative, the nucleic acid molecule according to the present invention can also be a nucleic acid which comprises a stretch of at least 15 bases of the nucleic acid molecule according to the first or second alternative of the nucleic acid molecules according to the present invention as outlined above. Preferably, the bases form a contiguous stretch of bases. However, it is also within the scope of the present invention that the stretch consists of two or more moieties, which are separated by a number of bases.

The nucleic acid molecules according to the present invention may preferably consist of at least 20, even more preferred at least 30, especially at least 50 contiguous bases from the sequences disclosed herein. The suitable length may easily be optimised due to the intended field of use (e.g. as (PCR) primers, probes, capture molecules (e.g. on a (DNA) chip), etc.). Preferred nucleic acid molecules contain at least a contiguous 15 base portion of one or more of the immunogenic amino acid sequences listed in Table 4. Specifically preferred are nucleic acids containing a contiguous portion of a DNA sequence of any sequence contained in the sequence protocol of the present application which shows 1 or more, preferably more than 2, especially more than 5, non-identical nucleic acid residues compared to the genome sequences of non-typable *Haemophilus influenzae* 86-028NP, that are available at GenBank (LOCUS CP000057, 1,914,490 bp DNA circular, DEFINITION *Haemophilus influenzae* 86-028NP, complete genome. ACCESSION CP000057 AAET01000000 AAET01000001-AAET01000576). Specifically preferred non-identical nucleic acid residues are residues, which lead to a non-identical amino acid residue. Preferably, the nucleic acid sequences encode polypeptides, proteins, or antigens having at least 1, preferably at least 2, preferably at least 3 different amino acid residues compared to the published or listed nontypable *Haemophilus influenzae* counterparts mentioned above. Preferably, this kind of polypeptides, proteins, or antigens still has at least one of the characteristics of the molecules disclosed herein having identical amino acid residues. Also preferred are such isolated polypeptides, which are fragments of the proteins or of the antigens disclosed herein, e.g. in the Sequence Listing, having at least 6, 7, or 8 amino acid residues and being encoded by the nucleic acids as described herein.

The nucleic acid molecule according to the present invention can, as a fourth alternative, also be a nucleic acid molecule which anneals under stringent hybridisation conditions to any of the nucleic acids of the present invention according to the first, second, or third alternative as disclosed herein. Stringent hybridisation conditions are typically those described herein.

Finally, the nucleic acid molecule according to the present invention can, as a fifth alternative, also be a nucleic acid molecule which, but for the degeneracy of the genetic code, would hybridise to any of the nucleic acid molecules of the present invention according to the first, second, third, and fourth alternative as outlined herein. This kind of nucleic acid molecule refers to the fact that preferably the nucleic acids according to the present invention code for the antigen, or fragments or variants thereof, according to the present invention. This kind of nucleic acid molecule is particularly useful in the detection of a nucleic acid molecule according to the present invention and thus the diagnosis of the respective microorganisms such as nontypable *Haemophilus influenzae* or any pathogenic nontypable *Haemophilus influenzae* species, and any disease or diseased condition where these kinds of microorganism are involved. Preferably, such microorganism, especially an opportunistic microorganism, is causing such disease directly or indirectly. Preferably, the hybridisation could occur or be preformed under stringent conditions as described in connection with the fourth alternative described herein.

Nucleic acid molecule as used herein generally refers to any ribonucleic acid molecule, such as mRNA or cRNA, or deoxyribonucleic acid molecule, including, for instance, cDNA and genomic DNA obtained by cloning or produced by chemical synthetic techniques or by a combination thereof. The nucleic acid molecule may be unmodified RNA or DNA or modified RNA or DNA. Thus, for instance, nucleic acid molecule as used herein refers to, among others, single- and double-stranded DNA, DNA that is a mixture of single- and double-stranded DNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may be derived from one or more of the molecules, but more typically involve only a region of some of the molecules. One of the molecules of a triple-helical region often is an oligonucleotide. Single-stranded DNA may be the coding strand, also known as the sense strand, or it may be the non-coding strand, also referred to as the anti-sense strand. As used herein, the term nucleic acid molecule includes DNAs or RNAs as described above that contain one or more modified bases. Thus, DNAs or RNAs with backbones modified for stability or for other reasons are nucleic acid molecules as that term is intended herein. Moreover, DNAs or RNAs comprising unusual bases, such as inosine, or modified bases, such as tritylated bases, to name just two examples, are nucleic acid molecules as the term is used herein. It will be appreciated that a great variety of modifications can be made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the present application, more specifically of the nontypable *Haemophilus influenzae* coding regions, which can be generated by standard cloning methods. To be unique, a fragment must be of sufficient size to distinguish it from other known nucleic acid sequences, most readily determined by comparing any selected nontypable *Haemophilus influenzae* fragment to the nucleotide sequences in biosequence databases such as GenBank. It will be appreciated by the one skilled in the art that what is said herein in any aspect in relation to nontypable *Haemophilus influenzae* applies equally to any other nontypable *Haemophilus influenzae* species, more preferably any pathogenic nontypable *Haemophilus influenzae* species.

Additionally, modifications can be made to the nucleic acid molecules and polypeptides that are encompassed by the present invention. For example, the nucleic acid also includes sequences that are a result of the degeneration of the genetic code. There are 20 natural amino acids, most of which are specified by more than one codon. Thus, nucleotide substitutions can be made which do not affect the polypeptide encoded by the nucleic acid. Accordingly, any nucleic acid molecule which encodes an antigen or fragments thereof is encompassed by the present invention.

Furthermore, any of the nucleic acid molecules encoding antigens or fragments thereof provided by the present invention can be functionally linked, using standard techniques such as standard cloning techniques, to any desired regulatory sequences, whether a nontypable *Haemophilus influenzae* regulatory sequence or a heterologous regulatory sequence, heterologous leader sequence, heterologous marker sequence or a heterologous coding sequence to create a fusion protein.

The present invention further relates to variants of the nucleic acid molecules described herein which encode fragments, analogs and derivatives of the antigens and fragments thereof having a deducted nontypable *Haemophilus influenzae* amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have a nontypable *Haemophilus influenzae* sequence as set forth in the Sequence Listing, in which several, a few, 5 to 10, 1 to 5, 1 to 4, 3, 2, 1 or no amino acid(s) is substituted, deleted or added, in any combination. Especially preferred among these are silent substitutions, additions and deletions, which do not alter the properties and activities of the nontypable *Haemophilus influenzae* polypeptides set forth in the Sequence Listing. Also especially preferred in this regard are conservative substitutions.

The nucleic acid molecules of the present invention may also be used as a hybridisation probe for, e.g., RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labelled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for the development or preparation of pharmaceutical compositions and/or diagnostics for diseases, particularly human disease, as further discussed herein.

The nucleic acid molecules of the present invention that are oligonucleotides can be used in the processes herein as described, but preferably for PCR, to determine whether or not the nontypable *Haemophilus influenzae* genes identified herein in whole or in part are present and/or transcribed in infected tissue such as skin, synovia or blood. It is recognized that such sequences will also have utility in diagnosis of the stage of infection and type of infection the pathogen has attained. For this and other purposes arrays which are known as such in the art, comprising at least one of the nucleic acids or polypeptides according to the present invention as described herein, may be used.

The nucleic acid molecules according to the present invention may be used for the detection of nucleic acid molecules and organisms or samples containing these nucleic acids. Preferably such detection is for diagnosis, more preferably for the diagnosis of a disease related or linked to the presence or abundance of nontypable *Haemophilus influenzae*.

Eukaryotes (herein also "individual(s)"), particularly mammals, and especially humans, infected with nontypable *Haemophilus influenzae* can be identified by detecting any of the nucleic acid molecules according to the present invention detected at the DNA level by a variety of techniques. Preferred nucleic acid molecule candidates for distinguishing nontypable *Haemophilus influenzae* or other pathogenic nontypable *Haemophilus influenzae* from other organisms can be obtained.

The invention provides a process for diagnosing disease, arising from infection with nontypable *Haemophilus influenzae*, comprising determining from a sample isolated or derived from an individual an increased level of expression of a nucleic acid molecule having the sequence of a nucleic acid molecule as disclosed herein and more preferably set forth in the Sequence Listing. Expression of nucleic acid molecules can be measured using any one of the methods well known in the art for the quantification of nucleic acid molecules, such as, for example, PCR, RT-PCR, RNase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated", but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion genes, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids can, for example, be isolated from nontypable *Haemophilus influenzae* by methods known to the one skilled in the art. The same applies to the polypeptides according to the present invention.

Preferably, the nucleic acid molecules of the present invention may be originally formed in vitro, e.g. by chemical synthesis, or in a cell culture and subsequent isolation or purification. In general, the nucleic acids may be obtained by the manipulation of nucleic acids by endonucleases and/or exonucleases and/or polymerases and/or ligases and/or recombinases or other methods known to the skilled practitioner to produce the nucleic acids.

The nucleic acid sequences as defined by SEQ ID NOs 636 to 641, 643, 646, 648 or 1 to 156 start with the first complete codon comprised by the fragment as inserted into the vector and encodes the first amino acid as defined by SEQ ID NOs 656 to 661, 663, 666, 668 or 157 to 312. However, for the recombinant production additional nucleic acids might be useful or necessary to facilitate the cloning and expression.

The present invention also relates to vectors, which comprise a nucleic acid molecule or nucleic acid molecules of the present invention. A vector may additionally include nucleic acid sequences that permit it to replicate in the host cell, such as an origin of replication, one or more therapeutic genes and/or selectable marker genes and other genetic elements known in the art such as regulatory elements directing transcription, translation and/or secretion of the encoded protein. The vector may be used to transduce, transform or infect a cell, thereby causing the cell to express nucleic acids and/or proteins other than those native to the cell. The vector optionally includes materials to aid in achieving entry of the nucleic acid into the cell, such as a viral particle, liposome, protein coating or the like.

The present invention also relates to host cells, which are genetically engineered with vectors of the invention and to the production of the polypeptides according to the present invention by recombinant techniques.

A great variety of expression vectors can be used to express the polypeptides according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and the polypeptides according to the present invention. Nucleic acid constructs in host cells can be used in a conventional manner to produce the gene product encoded by the recombinant sequence. Alternatively, the polypeptides according to the preset invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as streptococci, staphylococci, *E. coli, Streptomyces* and *Bacillus subtilis* cells; fungal cells, such as yeast cells and *Aspergillus* cells; insect cells such as *Drosophila* S2 and *Spodoptera* Sf9 cells; animal cells such as CHO, COS, HeLa, C127, 3T3, BHK, 293, Vero, PER.C6® and Bowes melanoma cells; and plant cells.

The host cells can be transfected, e.g. by conventional means such as electroporation with at least one expression vector containing a nucleic acid of the invention under the control of a transcriptional regulatory sequence.

According to another aspect of the present invention, a comprehensive set of novel polypeptides is provided. Such polypeptide, as mentioned previously herein, are antigens as disclosed herein, and the fragments thereof, preferably the active fragments thereof, and the variants thereof, preferably the active variants thereof. Preferably, the polypeptides according to the present invention are antigens and fragments thereof. In a preferred embodiment of the invention, an antigen comprising an amino acid sequence being preferably encoded by any one of the nucleic acids molecules and fragments thereof as described herein, are provided. In another preferred embodiment of the invention a novel set of proteins and antigens and active fragments as well as active variants thereof is provided which comprise amino acid sequences selected from the group consisting of SEQ ID NOs 656 to 661, 663, 666, 668 and 157 to 312.

The polypeptides according to the present invention, i.e. the antigens, as provided by the present invention preferably include any polypeptide or molecule set forth in the Sequence Listing as well as polypeptides which have at least 70% identity to such polypeptide according to the present invention, preferably at least 80% or 85% identity to such polypeptide according to the present invention, and more preferably at least 90% similarity (more preferably at least 90% identity) to such polypeptide according to the present invention and more preferably as set forth in the Sequence Listing and still more preferably at least 95%, 96%, 97%, 98%, 99% or 99.5% similarity (still more preferably at least 95%, 96%, 97%, 98%, 99%, or 99.5% identity) to such polypeptide according to the present invention and also include portions of such polypeptides with such portion of the polypeptide generally containing at least 4 amino acids and more preferably at least 8, still more preferably at least 30, still more preferably at most 50 amino acids, such as 4, 8, 10, 20, 30, 35, 40, 45 or 50 amino acids. In a preferred embodiment such portions are active fragments of the polypeptides according to the present invention.

The invention also relates to fragments, analogs, and derivatives of the polypeptides according to the present invention. The terms "fragment", "derivative" and "analog" when referring to such polypeptide whose amino acid sequence is preferably set forth in the Sequence Listing, means a polypeptide which retains essentially the same or a similar biological activity as such polypeptide. It will be acknowledged by the ones skilled in the art that the meaning of the term "similar biological activity" as used herein preferably depends on the polypeptide under consideration and more specifically its function. The term "biological activity" as used herein is further defined below. More preferably, a similar biological function or activity differs from the function of the non-fragment or the non-derivative in terms of extent of activity, affinity, immunogenicity, stability and/or specificity. In a preferred embodiment the difference is less than 50%, less than 75% or less than 90%.

In an embodiment the fragment, derivative, variant or analog of a polypeptide according to the present invention is 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in which the polypeptide according to the present invention or a fragment thereof is fused with another compound, such as a compound to increase the half-life of the polypeptide according to the present invention or a fragment thereof such as, for example, polyethylene glycol, or 4) one in which the additional amino acids are fused to the polypeptide according to the present invention or a fragment thereof, such as a leader or secretory sequence or a sequence which is employed for purification of said polypeptide according to the present invention or fragment thereof or a proprotein sequence. Such fragments, derivatives, variants and analogs are deemed to be within the scope of those skilled in the art from the teachings herein.

The present invention also relates to proteins and antigens of nontypable *Haemophilus influenzae* species, preferably pathogenic nontypable *Haemophilus influenzae* species.

Such homologues may easily be isolated based on the nucleic acid and amino acid sequences disclosed herein.

There are multiple serotypes, genotypes or clinical strains distinguished to date for each of the pathogens and the typing is based on serotype specific antisera or molecular approaches. The presence of any antigen can accordingly be determined for every serotype, genotype or strain. The contribution of the various serotypes to the different nontypable *Haemophilus influenzae* infections varies in different age groups and especially geographical regions. It is an important aspect that the most valuable protective antigens need to be conserved among various clinical strains.

Additionally, fusion polypeptides comprising such antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

In another embodiment of the invention the peptide as defined above may be modified by a variety of chemical techniques to produce derivatives having essentially the same activity (as defined above for fragments and variants) as the un-modified peptides, and optionally having other desirable properties. For example, carboxylic acid groups of the protein, whether C-terminal or side chain, may be provided in the form of a salt of a pharmaceutically acceptable cation or esterified to form an ester, or converted to an amide. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be converted to an amide. Hydroxyl groups of the peptide side chains may be converted to alkoxy or to an ester using well recognized techniques. Phenyl and phenolic rings of the peptide side chains may be substituted with one or more halogen atoms, such as fluorine, chlorine, bromine or iodine, or with alkyl, alkoxy, carboxylic acids and esters thereof, or amides of such carboxylic acids. Thiols can be protected with any one of a number of well recognized protecting groups, such as acetamide groups.

Further particularly preferred in this regard are variants, analogs, derivatives and fragments, and variants, analogs and derivatives of the fragments, having the amino acid sequence of any polypeptide according to the present invention as disclosed herein and preferably set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the peptide of the present invention. Also especially preferred in this regard are conservative substitutions. Most highly preferred are peptides having an amino acid sequence set forth in the Sequence Listing without substitutions.

Variants of any of the antigens in their various embodiments disclosed herein and in particular the antigens and peptides specified herein by SEQ ID NOs 656 to 661, 663, 666, 668 or 157 to 312, can typically also be characterized by means of bioinformatics. Respective tools such as the NCBI Basic Local Alignment Search Tool (BLAST) (Altschul, S. et al., 1990) are available from several sources, including the National Center for Biotechnology Information (NCBI, Bethesda, Md.) and on the Internet, for use in connection with the sequence analysis programs blastp, blastn, blastx, tblastn and tblastx. For comparisons of amino acid sequences of at least 35 amino acids, the Blast 2 sequences function of NCBI Blast 2.0 was employed using the default BLOSUM62 matrix set to default parameters (gapped blastp; gap existence cost of 11, and a per residue gap cost of 1). When aligning short peptides (fewer than around 35 amino acids), the alignment is performed using the Blast 2 sequences function, employing the PAM30 matrix set to default parameters (open gap 9, extension gap 1 penalties). Methods for determining sequence identity over such short windows such as 15 amino acids or less are described at the website that is maintained by the National Center for Biotechnology Information in Bethesda, Md.

The active variant of an antigen is obtained by sequence alterations in the antigen, including each and any variant, fragment, analogue or derivative thereof, if not explicitly indicated to the contrary, wherein the polypeptide according to the present invention with the sequence alterations retains a function of the unaltered polypeptide according to the present invention, e.g. having a biological activity similar to that displayed by the complete antigen, including the ability to induce an immune response and/or to show protection against a nontypable *Haemophilus influenzae* organism e.g. in a mouse model of nontypable *Haemophilus influenzae* infection. Suitable animal models are reviewed in T. F. Murphy 2005.

A further example of retaining the function of the unaltered polypeptide according to the present invention is that the active variant of the antigen specifically binds a polypeptide specific antibody that binds an unaltered form of the polypeptide according to the present invention. By "biological function" or "biological activity" is preferably meant a function of the polypeptide in cells or organisms in which it naturally occurs, even if the function is not necessary for the growth or survival of the cells and organisms, respectively. For example, the biological function of a porin is to allow the entry into cell of compounds present in the extracellular medium. The biological function is distinct from the antigenic function. A polypeptide according to the present invention can have more than one biological function.

The sequence alterations of such variants can include, but are not limited to, conservative substitutions, deletions, mutations and insertions. Among preferred variants are those that vary from a reference by conservative amino acid substitutions. Conservative substitutions are those that substitute a given amino acid in a polypeptide according to the present invention by another amino acid of like characteristics, i.e. those substitutions that take place within a family of amino acids that are related in their side chains and chemical properties. Examples of such families are amino acids with basic side chains, with acidic side chains, with non-polar aliphatic side chains, with non-polar aromatic side chains, with uncharged polar side chains, with small side chains, with large side chains, etc. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

In one embodiment, one conservative substitution is included in the peptide. In another embodiment, two conservative substitutions or less are included in the peptide. In a further embodiment, three conservative substitutions or less are included in the peptide.

Examples of conservative amino acid substitutions include, but are not limited to, those listed below:

| Original Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| His | Asn; Gln |
| Ile | Leu; Val |
| Leu | Ile; Val |
| Lys | Arg; Gln; Asn |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

Preferably, the active variant exhibits reactivity with human sera of patients with nontypable *Haemophilus influenzae* infections, more preferably mediates seroconversion and most preferably shows bactericidal activity. These characteristics of the active variant can be assessed e.g. as detailed in the Examples. In the context of the present invention a variant specifically binds a specific antibody (preferably being polyclonal antibodies raised against recombinant proteins in animals such as mouse, rabbit or monoclonal antibodies generated in mouse), exhibits reactivity with human sera from patients with nontypable *Haemophilus influenzae* infections, mediates seroconversion or shows bactericidal activity, if the activity of the variant amounts to at least 10%, preferably at least 25%, more preferably at least 50%, even more preferably at least 70%, still more preferably at least 80%, especially at least 90%, particularly at least 95%, most preferably at least 99% of the activity of the antigen without sequence alterations.

Said active variants include naturally-occurring allelic variants, as well as mutants or any other non-naturally occurring variants. As is known in the art, an allelic variant is an alternate form of a (poly)peptide that is characterized as having a substitution, deletion, or addition of one or more amino acids that does essentially not alter the biological function of the polypeptide, as it is described above.

Within any species of the living world, allelic variation is the rule. For example, any bacterial species, e.g. nontypable *Haemophilus influenzae*, is usually represented by a variety of strains (characterized by clonal reproduction) that differ from each other by minor allelic variations. Indeed, a polypeptide that fulfils the same biological function in different strains can have an amino acid sequence that is not identical in each of the strains. Such an allelic variation is equally reflected at the nucleotide level.

In a preferred embodiment, the active variant or the active fragment derived from the polypeptide according to the present invention by amino acid exchanges, deletions or insertions may also conserve, or more preferably improve, the activity (reactivity, seroconversion and/or bactericidal activity as defined herein). Furthermore, these polypeptides may also cover epitopes, which trigger the same or preferably an improved T cell response. These epitopes are referred to as "heteroclitic" as further defined herein. They have a similar or preferably greater affinity to MHC/HLA molecules, and the ability to stimulate the T cell receptors (TCR) directed to the original epitope in a similar or preferably stronger manner. Heteroclitic epitopes can be obtained by rational design i.e. taking into account the contribution of individual residues to binding to MHC/HLA as for instance described by Rammensee H. et al., (1999), combined with a systematic exchange of residues potentially interacting with the TCR and testing the resulting sequences with T cells directed against the original epitope. Such a design is possible for a skilled person in the art without undue experimentation.

In a still more preferred embodiment of the invention the active variant of a polypeptide according to the present invention is any of the polypeptides disclosed herein and more specifically any of the polypeptides defined by the SEQ ID NOs 656 to 661, 663, 666, 668 or 157 to 312, having at least 50% sequence identity to the polypeptides of any of said SEQ ID NOs 656 to 661, 663, 666, 668 or 157 to 312, especially at least 60%, preferably at least 70%, more preferably at least 80%, still more preferably at least 90%, even more preferably at least 95%, 96%, 97%, 98%, most preferably 99% sequence identity to the polypeptides of any of said SEQ ID NOs 656 to 661, 663, 666, 668 or 157 to 312 and/or is derived from said polypeptides of any of the sequences of SEQ ID NOs 656 to 661, 663, 666, 668 or 157 to 312 by conservative substitutions as defined above.

The polypeptides according to the present invention, and fragments and variants thereof, also include or consist of modified epitopes wherein preferably one or two of the amino acids of a given epitope are modified or replaced according to the rules disclosed in, e.g., Tourdot, S. et al., (2000), as well as the nucleic acid sequences encoding such modified epitopes. The epitopes as presented by the polypeptides according to the present invention are also referred to herein as the present epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from nontypable *Haemophilus influenzae*, but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Another possibility for identifying epitopes and more specifically heteroclitic epitopes includes the screening of peptide libraries with T cells directed against one or several of the present epitopes. A preferred way is the positional scanning of synthetic peptide libraries. Such approaches have been described in detail for instance by Hemmer, B. et al., (1999) and the references given therein.

As an alternative to epitopes represented by the present derived amino acid sequences or heteroclitic epitopes as disclosed herein, also substances or compounds mimicking these epitopes which are also referred to herein as "peptidemimetica" or "retro-inverse-peptides" can be applied and are thus within the present invention.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-γ, GM-CSF, TNF-alpha, flt3-ligand and others.

The polypeptides according to the present invention are preferably provided in an isolated form, and preferably are purified to homogeneity.

In another embodiment of the present invention the variant is a fragment. The fragment is characterized by being derived from the antigen as defined above by one or more amino acid deletions. The deletion(s) may be, C-terminally, N-terminally and/or internally. Preferably the fragment is obtained by at most 10, 20, 30, 40, 50, 60, 80, 100, 150 or 200, more preferably by at most 10, 20, 30, 40 or 50, even more preferably at most 5, 10 or 15, still more preferably at most 5 or 10, most preferably 1, 2, 3, 4 or 5 deletion(s). The active fragment of the invention is characterized by having a biological activity similar to that displayed by the complete antigen, including the ability to induce an immune response and/or to show protection against nontypable *Haemophilus influenzae* e.g. in a mouse model of nontypable *Haemophilus influenzae* infection, such as described above. The fragment of an antigen is active in the context of the present invention, if the activity of the fragment amounts to at least 10%, preferably at least 25%, more preferably at least 50%, even more preferably at least 70%, still more preferably at least 80%, especially at least 90%, particularly at least 95%, most preferably at least 99% of the activity of the antigen without sequence alteration. These fragments may be designed or obtained in any desired length, including as small as about 50 to 80 amino acids in length.

In a further embodiment a fragment, and more preferably an active fragment, of the polypeptide according to the present invention are characterised by structural or functional attributes, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha-amphipathic regions, beta-amphipathic regions, flexible regions, surface-forming regions, substrate binding regions, and high antigenic index regions of the polypeptide according to the present invention, and combinations of such fragments. Preferred regions are those that mediate antigenicity and antibody binding activities of the polypeptides according to the present invention. Most highly preferred in this regard are fragments that have a chemical, biological or other activity of the antigen and fragments thereof of the present invention, including those with a similar activity or an improved activity, whereby such improved activities are immunogenicity and stability, or with a decreased undesirable activity, whereby such decreased undesirable activity is enzymatic and toxic function and generation of human cross-reactive antibodies. Particularly preferred are fragments comprising receptors or domains of enzymes that confer a function essential for viability of nontypable *Haemophilus influenzae*, or the ability to cause disease in humans. Further preferred fragments of the polypeptides according to the present invention are those that comprise or contain antigenic or immunogenic determinants in an animal, especially in a human. Such fragments are also referred to as antigenic fragment.

An antigenic fragment is preferably defined as a fragment, which is antigenic by itself or may be made antigenic when provided as a hapten. Therefore, also antigens or antigenic fragments showing one or, particularly for longer fragments, only a few amino acid exchanges are enabled by the present invention, provided that the antigenicity or antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of the polypeptides according to the present invention are the core amino acid sequence as indicated in Table 4.

All these fragments listed in Table 4 individually and each independently form a preferred selected aspect of the present invention.

It will be appreciated that the invention also relates to, among others, nucleic acid molecules encoding the aforementioned fragments, variants, active variants, and active fragments, nucleic acid molecules that hybridise to nucleic acid molecules encoding the fragments, variants, active variants, and active fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The polypeptides according to the present invention may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification or to enhance expression. Such regions may be removed prior to final preparation of the polypeptide. The addition of peptide moieties to polypeptides to engender secretion or excretion, to improve stability, to enhance expression or to facilitate purification, among others, are familiar and routine techniques in the art. A preferred fusion protein comprises a heterologous region from immunoglobulin that is useful to solubilize or purify polypeptides. For example, EP 0464533 discloses fusion proteins comprising various portions of constant region of immunoglobin molecules together with another protein or part thereof. In drug discovery, for example, proteins have been fused with antibody Fc portions for the purpose of high-throughout screening assays to identify antagonists. See for example, (Bennett, D. et al., 1995) and (Johanson, K. et al., 1995). Fusions also may include the polypeptides according to the present invention fused or coupled to moieties other than amino acids, including lipids and carbohydrates. Further, antigens of this invention may be employed in combination with other vaccinal agents described by the prior art, as well as with other species of vaccinal agents derived from other microorganisms. Such proteins are useful in the prevention, treatment and diagnosis of diseases caused by a wide spectrum of nontypable *Haemophilus influenzae* isolates.

In a further embodiment the peptide of the invention is fused to an epitope tag which provides an epitope to which an anti-tag substance can selectively bind. The epitope tag is generally placed at the amino- or carboxyl-terminus of the peptide but may be incorporated as an internal insertion or substitution as the biological activity permits. The presence of such epitope-tagged forms of a peptide can be detected using a substance such as an antibody against the tagged peptide. Also, provision of the epitope tag enables the peptide to be readily purified by affinity purification using an anti-tag antibody or another type of affinity matrix that binds to the epitope tag. Various tag polypeptides and their respective antibodies are well known in the art. Examples include poly-histidine (poly-his), poly-histidine-glycine (poly-his-gly) tags, the HA tag polypeptide, the c-myc tag, the Strep tag and the FLAG tag.

The polypeptides of the invention may be prepared by any of a number of conventional techniques. For example, they can be produced by chemical synthesis as well as by biotechnological means. The latter comprise the transfection or transformation of a host cell with a vector containing a nucleic acid according to the present invention. In a preferred embodiment the vector is a vector according to the present invention. The biotechnological production of the polypeptides according to the present invention further comprises the cultivation of the transfected or transformed host cell under conditions, that allow expression of the protein and which are known to the one skilled in the art. The expressed protein is recovered, isolated, and optionally purified from the cell (or from the culture medium, if expressed extracellularly) by appropriate means known to one of skill in the art. For example, the proteins are isolated in soluble form following cell lysis, or extracted using known techniques, e.g. in guanidine chloride. The molecules comprising the polypeptides and antigens of this invention may be further purified using any of a variety of conventional methods including, but not limited to: ammonium sulfate or ethanol precipitation, acid extraction, liquid chromatography such as normal or reversed phase, using HPLC, FPLC and the like; affinity chromatography (such as with inorganic ligands or monoclonal antibodies), size exclusion chromatography, anion or cation exchange chromatography, phosphocellulose chromatography, hydrophobic interaction chromatography, hydroxylapatite chromatography, lectin chromatography, immobilized metal chelate chromatography, gel electrophoresis, and the like. One of skill in the art may select the most appropriate isolation and purification techniques without departing from the scope of this invention. Such purification provides the antigen in a form substantially free from other proteinaceous and non-proteinaceous materials of the microorganism.

An alternative approach to prepare polypeptides according to the invention involves generating the fragments of known peptides by enzymatic digestion, e.g., by treating the protein with an enzyme known to cleave proteins at sites defined by particular amino acid residues, or by digesting the DNA with suitable restriction enzymes, expressing the digested DNA and isolating the desired fragment. Yet another suitable technique involves isolating and amplifying a DNA fragment encoding a desired peptide fragment, by polymerase chain reaction (PCR). Oligonucleotides that define the desired termini of the DNA fragment are employed as the 5' and 3' primers in the PCR. Techniques for making mutations, such as deletions, insertions and substitutions, at predetermined sites in DNA, and therefore in proteins, having a known sequence are well known. One of skill in the art using conventional techniques, such as PCR, may readily use the antigens and peptides provided herein to identify and isolate other similar proteins. Such methods are routine and not considered to require undue experimentation, given the information provided herein. For example, variations can be made using oligonucleotide-mediated site-directed mutagenesis (Carter, P. et al., 1985; Zoller, M. J. et al., 1987), cassette mutagenesis (Wells, J. A. et al., 1985), restriction selection mutagenesis (Wells, J. A. et al., 1986), PCR mutagenesis, or other known techniques can be performed on the cloned DNA to produce the peptide of the invention.

The polypeptide according to the present invention may be used for the detection of the organism or organisms in a sample containing these organisms or proteins or antigens, including fragments thereof. Preferably such detection is for diagnosis, more preferable for the diagnosis of a disease, most preferably for the diagnosis of a disease related or linked to the presence or abundance of Gram-negative bacteria, especially pathogenic nontypable *Haemophilus influenzae* species.

The nucleic acids according to the present invention can also be used for the diagnosis or detection of organisms in a sample, whereby the organisms are preferably the same ones as disclosed in connection with the use of the polypeptides according to the present invention and the antibody according to the present invention, respectively. Basically, it is within the skills of the person of the art to design and practice such diagnosis and detection assays and methods, respectively, in the light of the present disclosure. More preferably such diagnosis or detection uses primers or probes to specifically interact with the nucleic acid molecules according to the present invention. The length and design of such primers and probes, respectively, varies depending on the particular method or diagnosis practiced. Using, in a preferred embodiment, a primer for, e.g., a PCR based detection or diagnosis system, i.e. method or assay, the length of the primer will range from about 10 nucleotides to about 30 nucleotides and more preferably from about 16 to 25 nucleotides. In case of a probe based detection or diagnosis system the length of the probe is preferably about the same as specified for the primer based system. Additionally, in case of a probe based system, the probe will comprise a moiety which allows its detection, either directly or indirectly. Such moiety for direct detection can be a radioactive label or a fluorescence label as known to the ones skilled in the art. Such moiety for indirect detection can be a biotin or any other moiety which mediates interaction with a further compound which in turn is labelled so as to allow its detection.

The present invention also relates to diagnostic assays, such as quantitative diagnostic assays for detecting levels of the polypeptides according to the present invention, and more preferably antigens and fragments thereof of the present invention, in cells and tissues, including determination of normal and abnormal levels. Thus, for instance, a diagnostic assay in accordance with the invention for detecting overexpression of the polypeptides according to the present invention compared to normal control tissue samples may be used to detect the presence of an infection, for example, and to identify the infecting organism. Assay techniques that can be used to determine levels of such polypeptides in a sample derived from a host are well known to those of skill in the art. Such assay methods include radioimmunoassays, competitive-binding assays, Western Blot analysis and ELISA assays. Among these, ELISA and Western Blot analysis frequently are preferred. An ELISA assay initially comprises preparing an antibody specific to one of the polypeptides according to the present invention, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme. One or several of the polypeptides according to the present invention and more preferably an antigen and fragment thereof according to the present invention may be immobilised on ELISA plates for detection of reactive antibodies in sera of patients or subjects to be tested.

A Western blot assay initially separates the polypeptides according to the present invention individually or in combination by SDS-polyacrylamide gelelectrophoresis and which subsequently are transferred and immobilised onto a solid support matrix, such as nitrocellulose, nylon or combinations thereof. Together with a reporter antibody reactive antibodies can be detected. The reporter antibody is attached to a detectable reagent such as radioactive, fluorescent or enzymatic reagent, such as horseradish peroxidase enzyme.

The polypeptides according to the present invention or the nucleic acid molecules according to the present invention or primers or probes directed thereto as described herein, may also be used for the purpose of or in connection with an array. In case of the nucleic acid molecule according to the present invention and the primers and probes directed there against, the length of the probes and the primer, can also preferably be in the range from about 25 to about 75 nucleotides, more preferably from about 35 to about 50 nucleotides. More particularly, at least one of the polypeptides according to the present invention may be immobilized on a support. Said support typically comprises a variety of the polypeptides according to the present invention and/or antigens and fragments thereof whereby the variety may be created by using one or several of the antigens and fragments thereof according to the present invention and/or antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different polypeptides and more preferably different antigens and fragments thereof immobilized on a support may range from as little as 10 to several 1,000 different polypeptides and antigens and fragments thereof, respectively. The density of said molecules per $cm^2$ is in a preferred embodiment as little as 10 per $cm^2$ to at least 400 different of such polypeptides per $cm^2$ and more particularly at least 1,000 different of such polypeptides and more preferably different antigens and fragments thereof per $cm^2$. What is said herein about the immobilization of the polypeptides according to the present invention and their use, is also applicable to the nucleic acid molecules and the primers and probes, respectively, directed there against, as will be acknowledged by the ones skilled in the art.

The manufacture of such arrays is known to the one skilled in the art and, for example, described in U.S. Pat. No. 5,744, 309. The array preferably comprises a planar, porous or non-porous solid support having at least a first surface. The polypeptides according to the present invention are immobilized on said surface. Preferred support materials are, among others, glass or cellulose. It is also within the present invention that the array is used for any of the diagnostic applications described herein. Apart from the polypeptides according to the present invention also the nucleic acid molecules according to the present invention may be used for the generation of an array as described above which, in principle, can be used for any of the purposes disclosed for the array containing polypeptides. This applies as well to an array made of antibodies, preferably monoclonal antibodies as, among others, described herein.

In a further aspect the present invention relates to an antibody directed to any of polypeptides according to the present invention, derivatives, fragments, variants, active fragments and active variants thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Such antibodies in general and in particular directed against the antigens and fragments thereof corresponding to a sequence of the present invention can be obtained by direct injection of a polypeptide according to the present invention into an animal or by administering said polypeptide to an animal, preferably a non-human. The antibody so obtained will then bind said polypeptide itself. In this manner, even a sequence encoding only a fragment said polypeptide can be used to generate antibodies binding the whole native polypeptides according to the present invention. Such antibodies can then be used to isolate the polypeptide according to the present invention from tissue expressing antigens and fragments thereof. It will be understood by the ones skilled in the art that this procedure is also applicable to the fragments, variants, active fragments and active variants thereof of said polypeptides.

Another aspect of the present invention relates to methods for producing antibodies according to the invention. This includes, for example, monoclonal and polyclonal antibodies, chimeric, single chain, and humanized antibodies, as well as Fab fragments, or the product of a Fab expression library, which are able to specifically bind to the peptide or composition according to the invention.

In a preferred embodiment the antibody is a monoclonal, polyclonal, chimeric or humanized antibody or functionally active fragment thereof. In another preferred embodiment the functionally active fragment comprises a Fab fragment.

Antibodies generated against the peptide or antigen or composition according to the invention can be obtained by direct injection of the peptide or antigen or composition according to the invention into an animal or administering of the peptide or antigen or composition according to the invention to an animal, preferably a non-human. The antibody so obtained will then bind the peptide or antigen or composition according to the invention. Such antibodies can then be used to isolate reactive antigens, peptide or proteins from a tissue expressing those.

For preparation of monoclonal antibodies, any technique known in the art, which provides antibodies produced by continuous cell line cultures, can be used (as described originally in Köhler, G. et al., 1975).

Techniques described for the production of single chain antibodies (U.S. Pat. No. 4,946,778) can be adapted to produce single chain antibodies to immunogenic antigens and fragments thereof in their diverse embodiments according to this invention. Also, transgenic mice, or other organisms such as other mammals, may be used to express humanized antibodies to the polypeptides according to the present invention.

Antibodies may also be produced using a hybridoma cell line.

Still another aspect of the invention relates to a hybridoma cell line which produces the antibody of the invention.

Hybridoma cell lines expressing desirable monoclonal antibodies are generated by well-known conventional techniques. The hybridoma cell can be generated by fusing a normal-activated, antibody-producing B cell with a myeloma cell. In the context of the present invention the hybridoma cell is able to produce an antibody specifically binding to the antigen of the invention.

Similarly, desirable high titre antibodies are generated by applying known recombinant techniques to the monoclonal or polyclonal antibodies developed to these antigens (see, e.g., PCT Patent Application No. PCT/GB85/00392; British Patent Application Publication No. GB2188638A; Amit, A. G. et al., 1986; Queen, C. et al., 1989; PCT Patent Application No. WO 90/07861; Riechmann, L. et al., 1988; Huse, W. D. et al., 1988).

Alternatively, the antibody may be produced employing display libraries. For example, phage display technology or ribosomal display could be utilized to select antibody genes with binding activities towards the polypeptides according to the present invention either from repertoires of PCR amplified v-genes of lymphocytes from humans screened for possessing respective target antigen binding antibodies or from naïve libraries (McCafferty, J. et al., 1990; Marks, J. et al., 1992). The affinity of these antibodies can also be improved by chain shuffling (Clackson, T. et al., 1991).

If two antigen binding domains are present, each domain may be directed against a different epitope—termed 'bispecific' antibodies.

The above-described antibodies may be employed to isolate or to identify clones expressing the polypeptides according to the present invention by attachment of the antibody to a solid support for isolation and/or purification by affinity chromatography.

Thus, among others, antibodies against the polypeptides according to the present invention may be employed to inhibit and/or treat infections, particularly bacterial infections and especially infections arising from pathogenic nontypable *Haemophilus influenzae* species.

The polypeptides according to the present invention and more specifically antigens and fragments thereof in their diverse embodiments include antigenically, epitopically or immunologically equivalent derivatives, which form a particular aspect of this invention. The term "antigenically equivalent derivative" as used herein encompasses such polypeptide according to the present invention or its equivalent which will be specifically recognized by certain antibodies which, when raised to said polypeptide, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The polypeptides according to the present invention and more specifically the antigens and fragments thereof in their diverse embodiments, such as an antigenically or immunologically equivalent derivative or a fusion protein thereof can be used as an antigen to immunize a mouse or other animal such as a rat or chicken. The fusion protein may provide stability to the polypeptide according to the present invention. Such polypeptide may be associated, for example by conjugation, with an immunogenic carrier protein, for example bovine serum albumin (BSA) or keyhole limpet haemocyanin (KLH). Alternatively, an antigenic peptide comprising multiple copies of the polypeptide according to the present invention and more preferably an antigen and fragments thereof, or an antigenically or immunologically equivalent antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complementarity determining region(s) of the hybridoma-derived antibody has been transplanted into a human monoclonal antibody, for example as described in (Jones, P. et al., 1986) or (Tempest, P. et al., 1991).

The use of a nucleic acid molecule according to the present invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment (Tang, D. et al., 1992; Eisenbraun, M. et al., 1993) and in vivo infection using cloned retroviral vectors (Seeger, C. et al., 1984).

In a further aspect the present invention relates to a peptide binding to any of the polypeptides according to the present invention, and a method for the preparation of such peptides whereby the method is characterized by the use of said polypeptide and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a polypeptide according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e.g. by propagating the peptide encoding phages. The characterisation preferably comprises the sequencing of the target binding peptides. Basically, the peptides are not limited in their lengths, however preferably peptides having a length from about 8 to 20 amino acids are preferably obtained in the respective methods. The size of the libraries may be about $10^2$ to $10^{18}$, preferably $10^8$ to $10^{15}$ different peptides, however, is not limited thereto. In a preferred embodiment such peptides are high-affinity binding peptides. In an even more preferred embodiment the peptides are peptide aptamers.

Peptide aptamers as used herein refer to peptide molecules that bind a specific target molecule. Peptide aptamers are designed to interfere with other protein interactions inside cells. They consist of a variable peptide loop attached at both ends to a protein scaffold. This double structural constraint greatly increases the binding affinity of the peptide aptamer to levels comparable to an antibody's (nanomolar range). The variable loop length is typically comprised of 10 to 20 amino acids, and the scaffold may be any protein which have good solubility and compacity properties.

Currently, the bacterial protein Thioredoxin-A is the most used scaffold protein, the variable loop being inserted within the reducing active site, which is a -Cys-Gly-Pro-Cys- loop in the wild protein, the two Cysteines lateral chains being able to form a disulfide bridge. Peptide aptamer selection can be made using different systems, but the most used is currently the yeast two-hybrid system. Selection of Ligand Regulated Peptide Aptamers (LiRPAs) has been demonstrated. By displaying 7 amino acid peptides from a novel scaffold protein based on the trimeric FKBP-rapamycin-FRB structure, interaction between the randomized peptide and target molecule can be controlled by the small molecule Rapamycin or non-immunosuppressive analogs.

A particular form of target binding peptides as described above, are the so-called "anticalines" which are, among others, described in German patent application DE 19742706. In so far, the present invention is also related to peptides specifically binding to the polypeptides according to the present invention and the use thereof for any of the therapeutic and diagnostic applications described herein, preferably for antibodies.

In a further aspect the present invention relates to functional nucleic acids interacting with any of the polypeptides according to the present invention, and a method for the preparation of such functional nucleic acids whereby the method is characterized by the use of the polypeptides according to the present invention and the basic steps are known to the one skilled in the art. The functional nucleic acids are preferably nucleic acid aptamers and spiegelmers. In so far, the present invention is also related to nucleic acid aptamers and spiegelmers specifically binding to the polypeptides according to the present invention and the use thereof for any of the therapeutic and diagnostic applications described herein, preferably for antibodies.

Nucleic acid aptamers are D-nucleic acids, which are either single stranded or double stranded and which specifically interact with a target molecule. The preparation or selection of aptamers is, e.g. described in European patent EP 0 533 838. Basically the following steps are realized. First, a mixture of nucleic acids, i.e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutic agents. However, it is also within the present invention that the thus selected or generated aptamers may be used for target validation and/or as lead substance for the development of pharmaceutical compositions, preferably of pharmaceutical compositions based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or preparation is based on a similar principle. The preparation of spiegelmers is described in international patent application WO 98/08856. Spiegelmers are L-nucleic acids, which means that they are composed of L-nucleotides rather than D-nucleotides, as aptamers are. Spiegelmers are characterized by the fact that they have a very high stability in biological systems and, comparable to aptamers, specifically interact with the target molecule against which they are directed. In the process of generating spiegelmers, a heterogeneous population of D-nucleic acids is created and this population is contacted with the optical antipode of the target molecule, in the present case for example with the D-enantiomer of the naturally occurring L-enantiomer of the antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids, which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the preparation of such functional nucleic acids whereby the method is characterized by the use of the nucleic acid molecules and their respective sequences according to the present invention and the basic steps are known to the one skilled in the art. The functional nucleic acids are preferably ribozymes, anti-sense oligonucleotides and siRNA. In so far, the present invention is also related to this kind of functional nucleic acid specifically binding to the polypeptides according to the present invention and the use thereof for any of the therapeutic and diagnostic applications described herein, preferably for antibodies.

Ribozymes are catalytically active nucleic acids, which preferably consist of RNA, which basically comprises two moieties. The first moiety shows a catalytic activity whereas the second moiety is responsible for the specific interaction with the target nucleic acid, in the present case the nucleic acid coding for the polypeptides according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid, which in the end results in the degradation of the target nucleic acid as well as the protein derived from the said target nucleic acid. Ribozymes, their use and design principles are known to the one skilled in the art, and, for example described in (Doherty, E. et al., 2001) and (Lewin, A. et al., 2001).

The activity and design of antisense oligonucleotides for the preparation of a pharmaceutical composition and as a diagnostic agent, respectively, is based on a similar mode of action. Basically, antisense oligonucleotides hybridise based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybrid complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides, which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligodeoxy-ribonucleotides.

Of particular relevance and usefulness for the present invention are those antisense oligonucleotides as more particularly described in the above two mentioned US patents. These oligonucleotides contain no naturally occurring 5'=>3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eukaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5'=>3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the polypeptides according to the present invention in their diverse embodiments may be used as or for the preparation of pharmaceutical compositions, especially vaccines. Preferably such pharmaceutical composition, preferably vaccine is, for the prevention or treatment of diseases caused by, related to or associated with nontypable *Haemophilus influenzae* species. In so far another aspect of the invention relates to a method for inducing an immunological response in an individual, particularly a mammal, which comprises inoculating the individual with the polypeptides according to the present invention in their diverse embodiments, or a fragment or variant thereof, adequate to produce antibodies to protect said individual from infection by the above microorganisms.

Yet another aspect of the invention relates to a method of inducing an immunological response in an individual which comprises, through gene therapy or otherwise, delivering a nucleic acid molecule according to the present invention, preferably functionally encoding antigens and fragments thereof in their diverse embodiments, for expressing the polypeptide according to the present invention in vivo in order to induce an immunological response to produce antibodies or a cell mediated T cell response, either cytokine-producing T cells or cytotoxic T cells, to protect said individual from disease, whether that disease is already established within the individual or not. One-way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses at least one of the polypeptides according to the present invention in their diverse embodiments. The immunological response may be used therapeutically or prophylactically and may take the form of antibody immunity or cellular immunity such as that arising from CTL or CD4+ T cells.

The polypeptides according to the present invention in their diverse embodiments may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also provided by this invention are methods using the nucleic acid molecule according to the present invention in their diverse embodiments in such genetic immunization experiments in animal models of infection with nontypable *Haemophilus influenzae*. Such molecules will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of the nontypable *Haemophilus influenzae* infection in mammals, particularly humans.

The polypeptides according to the present invention in their diverse embodiments may be used as an antigen for vaccination of a host to produce specific antibodies which protect against invasion of bacteria, for example by blocking adherence of bacteria to damaged tissue. Examples of tissue damage and thus damaged tissue include wounds in skin or connective tissue and mucosal tissues caused e.g. by viral infection (esp. respiratory, such as the flu) mechanical, chemical or thermal damage or by implantation of indwelling devices, or wounds in the mucous membranes, such as the mouth, mammary glands, urethra or vagina.

The present invention also includes a vaccine formulation, which comprises one or several of polypeptides according to the present invention in their diverse embodiments together with one or more suitable carriers and/or excipients. The pharmaceutically acceptable carriers and/or excipients useful in this invention are conventional and may include buffers, stabilizers, diluents, preservatives, and solubilizers. Remington's Pharmaceutical Sciences, by E. W. Martin, Mack Publishing Co., Easton, Pa., 15th Edition (1975), describes compositions and formulations suitable for pharmaceutical delivery of the (poly)peptides herein disclosed. In general, the nature of the carrier or excipients will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g. powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Since said polypeptides according to the present invention may be broken down in the stomach, they are preferably administered parenterally, including, for example, administration that is subcutaneous, intramuscular, intravenous, intradermal, intranasal or transdermal. Formulations suitable for parenteral administration include aqueous and non-aqueous sterile injection solutions which may contain anti-oxidants, buffers, bacteriostats and solutes which render the formulation isotonic with the body fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising one or several of the polypeptides according to the present invention in their diverse embodiments for nontypable *Haemophilus influenzae*. Such a pharmaceutical composition may comprise one, preferably at least two or more of said polypeptides against nontypable *Haemophilus influenzae* species. Optionally, such polypeptides may also be combined with antigens against even further pathogens in a combination pharmaceutical composition. Preferably, said pharmaceutical composition is a vaccine for preventing or treating an infection caused by a nontypable *Haemophilus influenzae* species, more preferably a pathogenic nontypable *Haemophilus influenzae* species, and/or other pathogens against which the antigens have been included in the vaccine.

According to a further aspect, the present invention relates to a pharmaceutical composition comprising a nucleic acid molecule according to the present invention. Such a pharmaceutical composition may comprise one or more nucleic acid molecules according to the present invention encoding a polypeptide according to the present invention. Optionally, such nucleic acid molecules encoding the polypeptides according to the present invention are combined with nucleic acid molecules encoding antigens against other pathogens in a combination pharmaceutical composition. Preferably, said pharmaceutical composition is a vaccine for preventing or treating an infection caused by nontypable *Haemophilus influenzae* species, more preferably pathogenic nontypable *Haemophilus influenzae* species, and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

In a preferred embodiment the pharmaceutical composition further comprises an immunostimulatory substance such as an adjuvant. The adjuvant can be selected based on the method of administration and may include polycationic substances, especially polycationic peptides, immunostimulatory nucleic acids molecules, preferably immunostimulatory oligo-deoxynucleotides (ODNs), especially Oligo(dIdC)$_{13}$ (SEQ ID NO: 627), peptides containing at least two LysLeuLys motifs, especially peptide KLKLLLLLKLK (SEQ ID NO: 628), alum, mineral oil-based adjuvants such as Freund's complete adjuvant, Freund's incomplete adjuvant, neuroactive compounds, especially human growth hormone, or any combination of one or more of the above mentioned adjuvants. Other suitable adjuvants may be selected from the group consisting of Montanide incomplete Seppic adjuvant such as ISA, oil in water emulsion adjuvants such as the Ribi adjuvant system, syntax adjuvant formulation containing muramyl dipeptide, or aluminum salt adjuvants or combinations thereof.

The term "Oligo(dIdC)$_{13}$" (SEQ ID NO: 627) as used in the present invention means a phosphodiester backboned single-stranded DNA molecule containing 13 deoxy (inosine-cytosine) motifs, also defined by the term [oligo-d(IC)$_{13}$]. The exact sequence is 5'-dIdCdIdCdIdCdIdCdIdCdIdCdIdCdIdCdIdCdIdCdIdCdIdCdIdC-3' (SEQ ID NO: 627). Oligo (dIdC)$_{13}$ (SEQ ID NO: 627) can also be defined by the terms (oligo-dIC$_{26}$); oligo-dIC$_{26\text{-}mer}$; oligo-deoxy IC, 26-mer; or oligo-dIC, 26-mer, as specified for example in WO 01/93903 and WO 01/93905.

It is also within the scope of the present invention that the pharmaceutical composition, especially a vaccine, comprises apart from one or several of the polypeptides according to the present invention in their diverse embodiments, and/or nucleic acid molecules in accordance with the present invention other compounds which are biologically or pharmaceutically active. Preferably, the vaccine composition comprises at least one polycationic peptide. The polycationic compound(s) to be used according to the present invention may be any polycationic compound, which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in (Ganz, T., 1999). These (poly)peptides may be of prokaryotic or animal or plant origin or may be produced chemically or recombinantly (WO 02/13857). Peptides may also belong to the class of defensins (WO 02/13857). Sequences of such peptides can be, for example, found in the Antimicrobial Sequences Databases www.bbcm.univ.trieste.it/~tossi/pag2.html.

Such host defense peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide, which has the amino acid sequence NH$_2$-RLAGLL-RKGGEKIGEKLKKIGQKIKNFFQKLVPQPE-COOH (SEQ ID NO: 629). Related or derived cathelin substances contain the whole or parts of the cathelin sequence with at least 15-20 amino acid residues. Derivations may include the substitution or modification of the natural amino acids by amino acids, which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunactivating substances.

Another preferred polycationic substance to be used in accordance with the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxyuridine residues (described in WO 01/93905 and WO 02/095027, incorporated herein by reference) may preferably be used as immunostimulatory nucleic acids in connection with the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857 and WO 02/095027 and WO 03/047602, incorporated herein by reference.

In addition or alternatively such vaccine composition may comprise apart from the polypeptides according to the present invention and the nucleic acid molecules according to the present invention, preferably the coding nucleic acid molecules according to the present invention, a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

Also, the pharmaceutical composition in accordance with the present invention is a pharmaceutical composition which comprises at least any of the following compounds or combinations thereof: the nucleic acid molecules according to the present invention, the polypeptides according to the present invention in their diverse embodiments, the vector according to the present invention, the cells according to the present invention, the antibody according to the present invention, the functional nucleic acids according to the present invention and the binding peptides such as the anticalines and high-affinity binding peptides and peptide aptamers, respectively, according to the present invention, any agonists and antagonists according to the present invention, preferably screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of an antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The composition may be used e.g. for immunization or treatment of a subject. The pharmaceutical composition encompasses at least one peptide of the invention; however, it may also contain a cocktail (i.e., a simple mixture) containing different peptides (including fragments and other variants) of the invention, optionally mixed with different antigenic proteins or peptides of other pathogens. Such mixtures of these peptides, polypeptides, proteins or fragments or variants thereof are useful e.g. in the generation of desired antibodies to a wide spectrum of nontypable *Haemophilus influenzae* isolates. The peptide(s) of the present invention may also be used in the form of a pharmaceutically acceptable salt. Suitable acids and bases which are capable of forming salts with the peptides of the present invention are well known to those of skill in the art, and include inorganic and organic acids and bases.

Still another aspect of the present invention is a pharmaceutical composition containing a nucleic acid selected from the group consisting of:
(i) a nucleic acid of the invention and/or a nucleic acid complementary thereto, and
(ii) optionally a pharmaceutically acceptable carrier or excipient.

The nucleic acid sequences, alone or in combination with other nucleic acid sequences encoding antigens or antibodies or directed to other pathogenic microorganisms, may further be used as components of a pharmaceutical composition. The composition may be used for immunizing or treating humans and/or animals with the disease caused by infection with nontypable *Haemophilus influenzae*. The pharmaceutically acceptable carrier or excipient may be as defined above.

In another embodiment, the nucleic acid sequences of this invention, alone or in combination with nucleic acid sequences encoding other antigens or antibodies from other pathogenic microorganisms, may further be used in compositions directed to actively induce a protective immune response to the pathogen in a subject. These components of the present invention are useful in methods for inducing a protective immune response in humans and/or animals against infection with nontypable *Haemophilus influenzae*.

For use in the preparation of the therapeutic or vaccine compositions, nucleic acid delivery compositions and methods are useful, which are known to those of skill in the art. The nucleic acid of the invention may be employed in the methods of this invention or in the compositions described herein as DNA sequences, either administered as naked DNA, or associated with a pharmaceutically acceptable carrier and provide for in vivo expression of the antigen, peptide or polypeptide. So-called "naked DNA" may be used to express the antigen, peptide or polypeptide of the invention in vivo in a patient. (See, e.g., Cohen, J., 1993, which describes similar uses of "naked DNA"). For example, "naked DNA" associated with regulatory sequences may be administered therapeutically or as part of the vaccine composition e.g., by injection.

Alternatively, a nucleic acid encoding the antigens or peptides of the invention or a nucleic acid complementary thereto may be used within a pharmaceutical composition, e.g. in order to express the antigens or peptides or polypeptides of the invention in vivo, e.g., to induce antibodies.

A preferred embodiment of the invention relates to a pharmaceutical composition, wherein the nucleic acid according to the invention is comprised in a vector and/or a cell. Vectors and cells suitable in the context of the present invention are described above. Vectors are particularly employed for a DNA vaccine. An appropriate vector for delivery may be readily selected by one of skill in the art. Exemplary vectors for in vivo gene delivery are readily available from a variety of academic and commercial sources, and include, e.g., adeno-associated virus (International patent application No. PCT/US91/03440), adenovirus vectors (Kay, M. et al., 1994; Ishibashi, S. et al., 1993), or other viral vectors, e.g., various poxviruses, vaccinia, etc. Recombinant viral vectors, such as retroviruses or adenoviruses, are preferred for integrating the exogenous DNA into the chromosome of the cell.

The pharmaceutical compositions of the present invention may be administered in any effective, convenient manner including, for instance, administration by topical, oral, anal, vaginal, intravenous, intraperitoneal, intramuscular, subcutaneous, intranasal, intratracheal or intradermal routes among others.

In therapy or as a prophylactic, the active agent of the pharmaceutical composition of the present invention may be administered to an individual as an injectable composition, for example as a sterile aqueous dispersion, which is preferably isotonic.

Preferably, the pharmaceutical composition of the present invention may be administered intranasally, e.g. as an aerosol formulation.

In general, intranasal vaccination represents an attractive non-invasive alternative to needle-based injection and provides superior protection at mucosal surfaces. Furthermore, mucosal as well as systemic immunity can be induced after intranasal immunizations.

Therefore, intranasal application is particularly suited for nontypable *Haemophilus influenzae* vaccines according to the present invention.

Alternatively the composition, preferably the pharmaceutical composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

In a preferred embodiment the pharmaceutical composition is a vaccine composition. Preferably, such vaccine composition is conveniently in injectable form or in an aerosol formulation for intranasal delivery. Conventional adjuvants may be employed to enhance the immune response. A suitable unit dose for vaccination with a protein antigen is for adults between 0.02 to 3 µg antigen/per kg of body weight and for children between 0.2 to 10 µg antigen/per kg body weight, and such dose is preferably administered 1-3 times and with an interval of 2 to 24 weeks.

An "effective amount" or "therapeutically effective amount" of an antigen, nucleic acid, vector, an antibody or a pharmaceutical composition of the invention may be calculated as that amount capable of exhibiting an in vivo effect, e.g. preventing or ameliorating a sign or symptom of infection with nontypable *Haemophilus influenzae*. Such amounts may be determined by one of skill in the art.

With the indicated dose range, no adverse toxicological effects are expected with the compounds of the invention, which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the preparation, use or sale of pharmaceuticals or biological products, reflecting approval by the agency of the preparation, use or sale of the product for human administration.

In connection with the present invention any disease related use as disclosed herein such as, e.g., use of the pharmaceutical composition or vaccine, is particularly a disease or diseased condition which is caused by, linked or associated with nontypable *Haemophilus influenzae*. A disease related, caused or associated with the bacterial infection to be prevented and/or treated according to the present invention includes chronic infections. Common sites include the upper and lower respiratory tract. The spectrum of clinical syndromes includes recurrent or chronic otitis media, pneumonia, upper respiratory tract disease, bronchitis, sinusitis, asthmatic bronchitis, adult-onset asthma, and chronic obstructive pulmonary disease.

It is within the present invention that each and any of the symptoms, diseases, disorders or syndromes described herein which are either directly or indirectly linked to or arise from a contact of an organism such as any animal or human with a nontypable *Haemophilus influenzae* species, preferably a pathogenic nontypable *Haemophilus influenzae* species are separately and independently indications, diseases or disorders in the meaning of the present invention. Accordingly and just by means of illustration, a disease in the sense of the present application is pneumonia as well as bronchitis and chronic obstructive pulmonary disease.

It is within the present invention that the disease for which the various compounds described herein can be used are also those diseases where the polypeptide according to the present invention is expressed or any disease where the compounds described herein such as the polypeptides according to the present invention, the vaccine, the antibody, and any aptamer and spiegelmer, respectively, are suitable for the treatment and/or diagnosis thereof. Such potential use can arise from cross-reactivity and homology, respectively. It understood by the one skilled in the art that any disease described in connection with the pharmaceutical composition according to the present invention can be subject to the use of the pharmaceutical composition described herein, and vice versa.

Treatment in the context of the present invention refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

In a still further embodiment the present invention is related to a screening method using any of the polypeptides according to the present invention or any of the nucleic acids according to the present invention. Screening methods as such are known to the one skilled in the art and can be designed such that an agonist or an antagonist is screened. In connection with such screening method preferably an antagonist is screened which in the present case inhibits or prevents the binding of any antigen and fragment thereof according to the present invention to an interaction partner. Such interaction partner can be a naturally occurring interaction partner or a non-naturally occurring interaction partner.

The invention also provides a method for screening compounds to identify those, which enhance (agonist) or block (antagonist) the function of the polypeptides according to the present invention or of the nucleic acid molecules of the present invention, such as its interaction with a binding molecule. The method of screening may involve high-throughput.

For example, to screen for agonists or antagonists, the interaction partner of the polypeptide according to the present invention, may be a synthetic reaction mix, a cellular compartment, such as a membrane, cell envelope or cell wall, or a preparation of any thereof, may be prepared from a cell that expresses a molecule that binds to the polypeptides according to the present invention. The preparation is incubated with labelled forms of such polypeptides in the absence or the presence of a candidate molecule, which may be an agonist or antagonist. The ability of the candidate molecule to bind the binding molecule is reflected in decreased binding of the labelled ligand. Molecules which bind gratuitously, i.e., without inducing the functional effects of said polypeptides, are most likely to be good antagonists. Molecules that bind well and elicit functional effects that are the same as or closely related to the polypeptides according to the present invention are good agonists.

The functional effects of potential agonists and antagonists may be measured, for instance, by determining the activity of a reporter system following interaction of the candidate molecule with a cell or appropriate cell preparation, and comparing the effect with that of polypeptides according to the present invention or molecules that elicit the same effects as said polypeptides. Reporter systems that may be useful in this regard include but are not limited to colorimetric labelled substrate converted into product, a reporter gene that is responsive to changes in the functional activity of the polypeptides according to the present invention, and binding assays known in the art.

Another example of an assay for antagonists is a competitive assay that combines the polypeptides according to the present invention and a potential antagonist with membrane-bound binding molecules, recombinant binding molecules, natural substrates or ligands, or substrate or ligand mimetics, under appropriate conditions for a competitive inhibition assay. The polypeptides according to the present invention can be labelled such as by radioactivity or a colorimetric compound, such that the molecule number of polypeptides according to the present invention bound to a binding molecule or converted to product can be determined accurately to assess the effectiveness of the potential antagonist.

Potential antagonists include small organic molecules, peptides, polypeptides and antibodies that bind to polypeptides according to the present invention and thereby inhibit or extinguish its activity. Potential antagonists may also be small organic molecules, peptides, polypeptides such as a closely related proteins or antibodies that bind to the same sites on a binding molecule without inducing functional activity of the polypeptides according to the present invention.

Potential antagonists include a small molecule, which binds to and occupies the binding site of the polypeptides according to the present invention thereby preventing binding to cellular binding molecules, such that normal biological activity is prevented. Examples of small molecules include but are not limited to small organic molecules, peptides or peptide-like molecules.

Other potential antagonists include antisense molecules (see (Okano, H. et al., 1991); OLIGODEOXYNUCLEOTIDES AS ANTISENSE INHIBITORS OF GENE EXPRESSION; CRC Press, Boca Raton, Fla. (1988), for a description of these molecules).

Preferred potential antagonists include derivatives of the antigens and fragments thereof of the invention.

As used herein the activity of a polypeptide according to the present invention is its capability to bind to any of its interaction partner or the extent of such capability to bind to its or any interaction partner.

In a particular aspect, the invention provides the use of the polypeptides according to the present invention antigens and fragments thereof, nucleic acid molecules or inhibitors of the invention to interfere with the initial physical interaction between a pathogen and mammalian host responsible for sequalae of infection. In particular the molecules of the invention may be used: i) in the prevention of adhesion of the nontypable *Haemophilus influenzae* species as disclosed herein, and more preferably the pathogenic species thereof to mammalian extracellular matrix proteins; ii) to block bacterial adhesion between mammalian extracellular matrix proteins and bacterial proteins which mediate tissue reaction; iii) or lead to evasion of immune defense; iv) to block the normal progression of pathogenesis in infections initiated other than by the implantation of in-dwelling devices or by other surgical techniques, e.g. through inhibiting nutrient acquisition.

Each of the DNA coding sequences provided herein may be used in the discovery, development and/or preparation of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with non-typable *Haemophilus influenzae*.

In a still further aspect the present invention is related to an affinity device. Such affinity device comprises as least a support material and any of the polypeptides according to the present invention, which is attached to the support material. Because of the specificity of said polypeptides for their target cells or target molecules or their interaction partners, said polypeptides allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The polypeptides according to the present invention may be attached to the matrix in a covalent or non-covalent manner. Suitable support material is known to the one skilled in the art and can be selected from the group consisting of cellulose, silicon, glass, aluminum, paramagnetic beads, starch and dextrane.

The present invention is further illustrated by the following Figures, Tables, Examples and the Sequence Listing, from which further features, embodiments and advantages may be taken. It is to be understood that the present examples are given by way of illustration only and not by way of limitation of the disclosure.

BRIEF DESCRIPTION OF THE DRAWINGS

FIG. 2 shows the characterization of the libraries.

FIG. 4 shows lung elimination of the bacteria in the mice immunized with control or NTHi vaccine candidate antigens after challenge with non-typeable *Haemophilus influenzae* (NTHi).

Table 1 shows the results of the screenings of the LHi 250 and LHi 50/2 fragmented-genome NTHi bacterial display libraries with the 3 pools of biotinylated human IgGs (P38, P40 and IC21).

Table 2 shows the reactivity of randomly selected bacterial clones from screenings with biotinylated human IgG in Western blotting.

Table 3 shows an example of validating antigenic NTHi proteins identified by screening bacterial display libraries using peptide ELISA.

Table 4 shows the 156 immunogenic NTHi ORFs identified by screening bacterial display libraries of the fragmented genome of NTHi 86-028NP with human immunoglobulin.

Table 5 shows a list of the 47 NTHi isolates used to examine the conservation of the 156 immunogenic NTHi ORFs identified by screening bacterial display libraries of the fragmented genome of NTHi 86-028NP with human immunoglobulin.

Table 6 shows the conservation in 47 NTHi isolates of the 156 immunogenic NTHi ORFs identified by screening bacterial display libraries of the fragmented genome of NTHi 86-028NP with human immunoglobulin.

Table 7 shows the PCR primer sequences used for the analysis of the conservation in 47 NTHi isolates of the 156 immunogenic NTHi ORFs identified by screening bacterial display libraries of the fragmented genome of NTHi 86-028NP with human immunoglobulin.

Table 8 shows the list of *Haemophilus influenzae* genes selected for expression.

The figures and tables to which it might be referred to in the specification are described in the following in more details.

Figure 1:
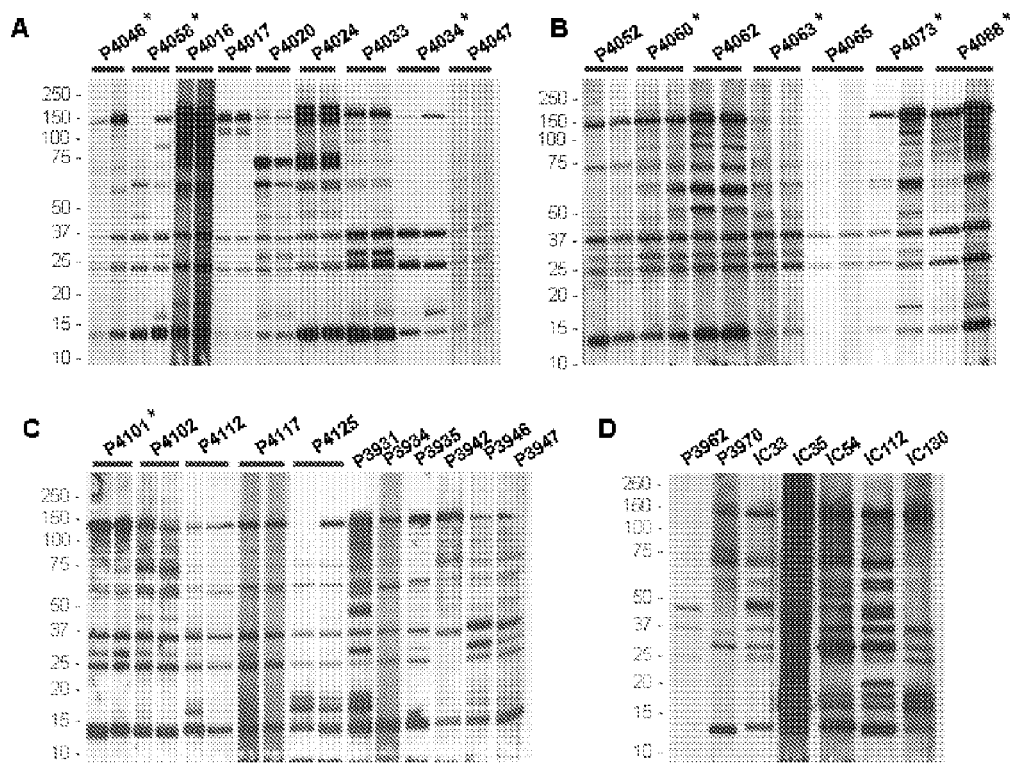
FIG. 1 shows the characterization of human sera as sources of pathogen specific antibodies.

FIG. 1. Characterization of Human Sera for Anti-NTHi Antibodies by Immunoblotting.

Lysates of nontypable *Haemophilus influenzae* NP 86-028 were separated on 4-20% gradient SDS-PAGE gels, transferred to nitrocellulose membranes and immunoblotted with human sera diluted 1:4,000. Molecular weight markers are indicated on the left.

Horizontal black bars indicate paired serum samples obtained from otitis media patients at the onset of disease (left under horizontal bar), and in the convalescent phase approximately 2 weeks later (right under horizontal bar). The figure indicates the reactivity of 21 such paired samples, i.e. 42 individual serum samples (panels A, B and left part of panel C).

In addition, the figure shows the reactivity of 13 single serum samples, comprising 6 sera from asthma patients (P3931-P3947, right part of panel C), 2 sera from recurrent otitis media patients (P3962 and P3970, left part of panel D), and 5 sera from healthy individuals (IC33-IC130, right part of panel D).

*Serum pairs selected for peptide ELISA.

The following sera were included in the pools used for library screening:
Pool IC21, sera IC33, IC35, IC54, IC112 and IC119 (healthy individuals).
Pool P38, sera P3931, P3934, P3946, P3947 and P3970 (children with asthma, age: 5-17 yr).
Pool P40, individual sera P4034.2, P4060.2, P4063.2, P4073.2 and P4088.2 (patients recovering from otitis media).

FIG. 2. Characterization of the Bacterial Display Libraries of the Fragmented Genome of NTHi 86-028NP.
A,B, LHi 50/2 library (LamB display scaffold)
A, The DNA sequences of the displayed fragments were determined for 262 bacterial library clones. Following trimming for vector sequence, the displayed sequences exhibited a size distribution from approximately 25 to 125 bp, with an average size of 68 bp.

B, The 262 bacterial library clone sequences were matched to the complete genome sequence of the library NTHi strain 86-028NP (GenBank accession NC_007146.2 GI:162960935). 132 bacterial library clone sequences matched annotated NTHi open reading frames, 22 matched alternative reading frames, 79 matched complementary reading frames, 15 matched non-ORF NTHi sequence, and 14 did not match the NTHi sequence. The clones not matching NTHi sequence most likely represented DNA corrupted during the blunt ending and ligation steps utilized in library construction. A low level of such clones is expected, and does not affect antigen identification. For the 132+22+79+15=248 bacterial library clone sequences matching the NTHi complete genome sequence, the distribution of the displayed fragments was mapped along the complete NTHi genome. The displayed fragments were distributed equally along the complete NTHi genome, which is 1,914,490 bp.

The 50/2 library comprised 648,500 cfu, giving a calculated coverage of the NTHi genome of 23-fold.

C,D, LH±250 library (FhuA display scaffold)

C, The DNA sequences of the displayed fragments were determined for 495 bacterial library clones. Following trimming for vector sequence, the displayed sequences exhibited a size distribution from approximately 75 to 300 bp, with an average size of 173 bp.

D, The 495 bacterial library clone sequences were matched to the complete genome sequence of the library NTHi strain 86-028NP (GenBank accession NC_007146.2 GI:162960935). 326 bacterial library clone sequences matched annotated NTHi open reading frames, 43 matched alternative reading frames, 56 matched complementary reading frames, 20 matched non-ORF NTHi sequence, and 50 did not match the NTHi sequence. The clones not matching NTHi sequence most likely represented DNA corrupted during the blunt ending and ligation steps utilized in library construction. A low level of such clones is expected, and does not affect antigen identification. For the 326+43+56+20=445 bacterial library clone sequences matching the NTHi complete genome sequence, the distribution of the displayed fragments was mapped along the complete NTHi genome. The displayed fragments were distributed equally along the complete NTHi genome, which is 1,914,490 bp.

The 250 library comprised 200,000 cfu, giving a calculated coverage of the NTHi genome of 18-fold.

Figure 3:
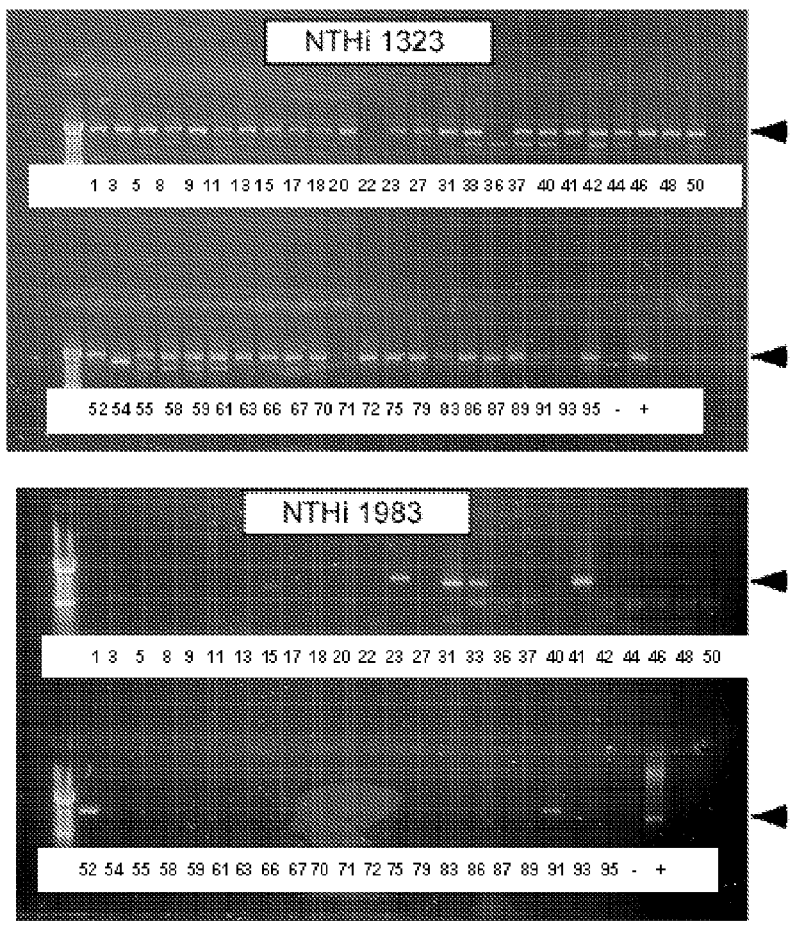
FIG. 3 shows the PCR analysis to determine the conservation of identified open reading frames encoding antigenic NTHi proteins.

FIG. 3. Conservation of Identified Open Reading Frames Encoding Antigenic NTHi Proteins.

A, an example of the PCR analysis of gene conservation for two NTHi open reading frames encoding antigenic proteins.

Genomic NTHi DNA was used as template for the PCR, at a dilution of 1:50. Negative control consisted of PCR on water. Two microliter of each PCR reaction was loaded on a 1% agarose gel. Top panel, gene NTHI1323. Bottom panel, gene NTHI1983. Expected position of PCR products is indicated by arrowheads (NTHI1323, 1660 bp; NTHI1983, 1042 bp). Numbers in lanes indicate NTHi strains (Table 5, internal Intercell reference number A). "−" indicates PCR on water. "+" indicates PCR on the NTHi library strain 86-028NP.

B, C, summary of the PCR analysis of the conservation in 47 NTHi isolates of all 156 identified ORFs encoding antigenic proteins. For each ORF encoding antigenic NTHi proteins, the level of conservation was calculated as 100× (number of PCR positive NTHi isolates/47). B, The number of NTHi ORFs is expressed as a function of the level of conservation. C, The cumulative percent of NTHi ORFs is expressed as a function of the level of conservation.

FIG. 4. Lung Elimination of the Bacteria in the Mice Immunized with Control or NTHi vaccine candidate antigens after challenge with non-typeable *Haemophilus influenzae* (NTHi).

(A) Bacterial clearance from the bronchoalveolar space expressed as a percentage of recovered bacteria from antigen-immunized mice compared to the number of bacteria recovered from the mice immunized with adjuvant vehicle control (PBS). Median values calculated for the entire experimental group are shown (10 mice per each antigen were tested). (B) Percentage of recovered bacteria from the lung tissue homogenate expressed in reference to the adjuvant control (PBS). (C) Percentage of recovered bacteria from both, bronchoalveolar space and lung tissue homogenate combined.

Abbreviations: WKC, whole killed cells; PBS, adjuvanted phosphate buffered saline without proteins added.

TABLE 1

Table 1. Screening of LHi 250 and LHi 50/2 libraries with the 3 pools of biotinylated human IgGs (P38, P40 and IC21). As negative control, no IgG was added to the libraries before magnetic sorting (MACS). Number of library *E. coli* used as input and eluted from the MACS columns are shown for all screens.

| [a]Screen | [b]Library | IgG pool | Cfu (Input) w/o IgG | Cfu (Input) 20 μg IgG | Cfu (Eluate) w/o IgG | Cfu (Eluate) 20 μg IgG | [c]Specific enrichment |
|---|---|---|---|---|---|---|---|
| HiF-P38 | LHi 250 | P38 | 3,000,000 | 2,100,000 | 640 | 2,400 | 5.4 |
| HiF-P40 | LHi 250 | P40 | 3,000,000 | 3,900,000 | 640 | 14,880 | 17.9 |
| HiF-IC21 | LHi 250 | IC21 | 700,000 | 2,800,000 | 2,000 | 19,200 | 2.4 |
| HiL-P38 | LHi 50/2 | P38 | 14,400,000 | 4,100,000 | 4,400 | 13,680 | 10.9 |
| HiL-P40 | LHi 50/2 | P40 | 14,400,000 | 8,400,000 | 4,400 | 34,040 | 13.3 |
| HiL-IC21 | LHi 50/2 | IC21 | 14,400,000 | 10,900,000 | 4,400 | 32,720 | 9.8 |

[a]Screening identifier.
[b]LHi 250, FhuA display library. LHi 50/2, LamB library.
[c]Calculated as: (cfu eluate 20 μg IgG/cfu input 20 μg IgG)/(cfu eluate without IgG/cfu input without IgG). Specific enrichment above 1 indicates that screening with human IgG bound more library clones than negative-control screening without human IgG, i.e., that the clones bound with human IgG were enriched for display of antigenic NTHi sequences.

TABLE 2

Table 2. Reactivity of randomly selected clones from screenings with biotinylated human IgG in Western blotting.

| [a]Screen | Number of bacterial clones tested by Western | Number of bacterial clones positive by Western | Percent of the bacterial clones positive by Western |
|---|---|---|---|
| HiF-IC21 | 164 | 53 | 32 |
| HiF-P38 | 102 | 82 | 80 |
| HiF-P40 | 110 | 99 | 90 |
| HiL-IC21 | 91 | 49 | 54 |
| HiL-P38 | 91 | 55 | 60 |
| HiL-P40 | 88 | 50 | 57 |

The same serum pools were used for MACS and Western.
[a]Screening identifier; a total of 6 screens were done, corresponding to Table 1.

TABLE 3

Table 3. Reactivity of overlapping peptides representing 3 antigenic NTHi proteins in ELISA. Overlapping peptide sets were synthesized for identified antigenic NTHi ORFs, and human sera were tested for anti-NTHi peptide reactivity by ELISA.

| Peptide | Seroconversion (OM patients) | | | | | | Recurrent OM | | Asthma | | |
|---|---|---|---|---|---|---|---|---|---|---|---|
| | P4034 | P4060 | P4046 | P4073 | P4058 | P4101 | P3962 | P3970 | P3935 | P3942 | P3947 |
| ntHI 0202-01 | 1.00 | 1.00 | 1.00 | 1.00 | 1.00 | 1.00 | 0 | 0 | 0 | 0 | 0 |
| ntHI 0202-02 | 4.93 | 1.09 | 1.00 | 1.54 | 1.00 | 1.16 | 0 | 0 | 115 | 0 | 172 |
| ntHI 0202-03 | 0.60 | 0.98 | 1.00 | 3.24 | 1.00 | 1.07 | 267 | 123 | 242 | 107 | 277 |
| ntHI 0202-04 | 0.47 | 0.74 | 1.00 | 2.42 | 1.00 | 0.93 | 228 | 190 | 198 | 164 | 191 |
| ntHI 0202-05 | 0.56 | 1.01 | 1.00 | 2.99 | 1.00 | 0.68 | 217 | 125 | 229 | 103 | 140 |
| ntHI 1667-01 | 1.00 | 1.00 | 1.00 | 1.00 | 1.00 | 1.00 | 0 | 0 | 0 | 0 | 0 |
| ntHI 1667-02 | 1.00 | 1.00 | 1.00 | 1.00 | 1.00 | 1.00 | 0 | 0 | 0 | 0 | 0 |
| ntHI 1667-03 | 1.00 | 1.00 | 1.36 | 1.00 | 6.28 | 1.00 | 0 | 0 | 0 | 0 | 0 |
| ntHI 1667-04 | 1.90 | 0.95 | 1.00 | 2.17 | 1.27 | 0.54 | 0 | 207 | 0 | 0 | 191 |
| ntHI 1667-05 | 1.61 | 2.24 | 1.00 | 2.94 | 2.17 | 0.42 | 0 | 277 | 124 | 0 | 382 |
| ntHI 1667-06 | 1.61 | 3.07 | 1.00 | 1.36 | 3.19 | 1.00 | 0 | 267 | 0 | 0 | 361 |
| ntHI 1667-07 | 1.03 | 5.89 | 1.00 | 1.38 | 3.97 | 1.00 | 0 | 0 | 104 | 0 | 0 |
| ntHI 1707-01 | 1.00 | 0.85 | 1.00 | 1.00 | 1.00 | 0.35 | 0 | 0 | 0 | 0 | 0 |
| ntHI 1707-02 | 1.00 | 0.73 | 1.00 | 1.00 | 1.00 | 1.20 | 0 | 0 | 0 | 0 | 0 |
| ntHI 1707-03 | 0.69 | 0.95 | 1.00 | 1.00 | 1.00 | 1.15 | 103 | 0 | 0 | 0 | 0 |
| ntHI 1707-04 | 1.00 | 0.85 | 1.00 | 1.00 | 1.00 | 1.22 | 0 | 100 | 0 | 0 | 0 |

| Peptide | Healthy individuals | | | | | RANKING SCORE |
|---|---|---|---|---|---|---|
| | IC33 | IC35 | IC54 | IC112 | IC130 | |
| ntHI 0202-01 | 0 | 0 | 0 | 0 | 0 | 0 |
| ntHI 0202-02 | 179 | 1049 | 589 | 837 | 481 | 19 |
| ntHI 0202-03 | 400 | 675 | 326 | 505 | 399 | 22 |
| ntHI 0202-04 | 267 | 441 | 323 | 173 | 314 | 18 |
| ntHI 0202-05 | 132 | 116 | 131 | 130 | 208 | 7 |
| ntHI 1667-01 | 0 | 0 | 0 | 0 | 0 | 0 |
| ntHI 1667-02 | 0 | 0 | 0 | 0 | 198 | 1 |
| ntHI 1667-03 | 0 | 0 | 0 | 0 | 0 | 5 |
| ntHI 1667-04 | 554 | 1042 | 686 | 841 | 838 | 21 |
| ntHI 1667-05 | 361 | 1117 | 934 | 969 | 915 | 31 |
| ntHI 1667-06 | 351 | 1038 | 932 | 945 | 936 | 29 |
| ntHI 1667-07 | 254 | 1094 | 868 | 939 | 912 | 24 |
| ntHI 1707-01 | 0 | 278 | 0 | 0 | 0 | 1 |
| ntHI 1707-02 | 0 | 110 | 0 | 162 | 0 | 1 |
| ntHI 1707-03 | 120 | 108 | 161 | 162 | 0 | 1 |
| ntHI 1707-04 | 171 | 307 | 156 | 0 | 350 | 3 |

"Seroconversion (OM patients)": paired serum samples were examined from the same otitis media patient, at the onset of disease, and in the convalescent phase, approximately 2 weeks later. The seroconversion values were calculated as the ratio between the ELISA reactivity of convalescent to acute serum samples. High seroconversion values indicate high anti-NTHi antibody levels in the convalescent sera.
"Recurrent OM": recurrent otitis media patients, single serum samples.
"Asthma": asthma patients, single serum samples.
"Healthy individuals": healthy individuals, single serum samples.
For the "Recurrent OM", "Asthma" and "Healthy individuals" serum samples, ELISA reactivity values were calculated as 1,000 × [(OD405 wells with serum added) − (OD405 wells with secondary antibody alone)]. ELISA reactivity values below 100 were considered negative. High ELISA reactivity values values indicate high anti-NTHi antibody levels in the sera.
"Ranking score": The immunoreactivity of individual synthetic peptides representing selected epitopes with human sera. 22 sera were tested in all, comprising 6 serum pairs, and 10 unpaired sera, as shown in the table.
Seroconversion (6 serum pairs) was assigned the following score values: >3 fold, 3 points. From 1.9 to 3-fold, 2 points. From 1.5 to 1.9-fold 1 point. ELISA reactivity (recurrent, asthma and healthy individual sera) was assigned the following score values: >500 ELISA units, 3 points. 250-499 ELISA units, 2 points. 150-249 ELISA units, 1 points. For peptides where seroconversion was not seen with any of the 6 paired serum samples, the ELISA reactivities were reduced by 50%. For each peptide, the final ranking score was calculated as the sum of seroconversion and ELISA reactivity scores for all 22 human sera.

TABLE 4

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0007 | formate dehydrogenase major subunit | 9-14, 23-44, 49-65, 68-74, 82-87, 91-104, 106-112, 115-123, 181-187, 192-215, 231-239, 244-250, 261-267, 272-283, 291-301, 305-312, 314-321, 361-378, 388-400, 412-420, 432-440, 467-475, 486-492, 494-505, 507-514, 533-550, 557-570, 583-591, 615-627, 652-662, 690-701, 727-733, 744-749, 782-790, 839-848, 857-863, 870-882, 895-902, 914-930, 954-964, 970-982, 1016-1023 | 2-87, 103-125, 127-205, 219-324, 334-647, 653-673, 676-701, 720-760, 768-798, 801-823, 827-856, 867-887, 891-928, 938-997, 1009-1028 | 10 | 3-21, 33-64, 94-192, 419-491, 626-705, 763-808 | 1 | 157 |
| NTHI0039 | penicillin-binding protein 2 | 27-56, 67-86, 93-101, 112-119, 138-145, 152-177, 181-187, 249-298, 303-309, 315-320, 323-328, 332-351, 362-370, 398-406, 453-462, 468-483, 496-512, 514-520, 528-533, 546-552, 555-561, 568-580, 582-588, 590-600, 609-636 | 1-217, 231-354, 359-380, 382-433, 435-455, 459-561, 587-607, 613-642 | 12 | 11-27, 74-137, 162-261, 301-335, 345-451 | 2 | 158 |
| NTHI0079 | N-acetylmuramoyl-L-alanine amidase AmiB precursor | 4-28, 47-65, 68-75, 77-85, 94-103, 114-120, 141-150, 157-166, 171-189, 194-215, 236-247, 292-299, 302-322, 382-390, 394-399, 403-415 | 1-32, 37-155, 157-216, 220-430 | 4 | 277-340, 384-411 | 3 | 159 |
| NTHI0083 | DNA repair protein RecN | 10-19, 23-28, 36-48, 62-71, 75-80, 92-99, 111-132, 135-161, 173-183, 190-200, 222-237, 245-259, 261-270, 275-290, 297-304, 309-342, 364-370, 379-389, 395-401, 414-420, 424-433, 440-469, 472-511, 523-537, 543-549 | 1-82, 90-183, 191-209, 237-257, 260-302, 306-324, 326-344, 351-430, 433-492, 505-557 | 5 | 7-80, 353-383, 498-536 | 4 | 160 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0088 | anaerobic ribonucleoside triphosphate reductase | 27-35, 37-45, 64-71, 77-87, 111-117, 124-157, 162-184, 207-223, 231-250, 255-284, 291-297, 306-316, 326-338, 352-360, 366-380, 384-393, 408-421, 434-441, 444-450, 456-472, 487-496, 519-531, 539-545, 548-558, 562-567, 575-589, 597-612, 614-620, 622-628, 630-636, 642-649, 657-667, 672-687 | 1-39, 59-101, 110-128, 131-162, 166-194, 198-257, 271-389, 402-568, 580-649, 655-684 | 11 | 187-256, 496-576, 659-707 | 5 | 161 |
| NTHI0126 | hypothetical protein | 12-61, 67-77, 79-95, 108-119, 121-151, 172-225 | 1-40, 48-228 | 1 | 87-124 | 6 | 162 |
| NTHI0127 | hypothetical protein | 4-10, 12-32, 36-65, 69-95, 108-113 | 1-67, 79-116 | 1 | 22-86 | 7 | 163 |
| NTHI0128 | hypothetical protein | 4-29, 43-51, 60-80, 82-93, 107-130 | 1-37, 54-133 | 5 | 84-104 | 8 | 164 |
| NTHI0130 | hypothetical protein | 5-10, 21-40, 60-76, 100-107, 126-134, 138-146, 150-160, 166-178, 192-204 | 1-110, 123-214 | 2 | 43-98 | 9 | 165 |
| NTHI0131 | hypothetical protein | 4-16, 20-26, 29-37, 43-65, 68-76, 91-108, 111-118, 142-154, 156-213, 229-236, 252-258, 262-269, 277-283 | 1-129, 139-174, 178-234, 249-289 | 8 | 131-152, 161-274 | 10 | 166 |
| NTHI0132 | hypothetical protein | 7-30, 46-52, 71-78, 86-94, 112-122, 131-145, 153-159, 236-241, 251-259, 266-277, 290-298, 304-325, 337-348, 364-377, 379-392, 399-404, 424-442 | 1-59, 65-89, 96-205, 224-289, 302-332, 354-413, 439-464 | 6 | 50-64, 131-236 | 11 | 167 |
| NTHI0134 | hypothetical protein | 4-14, 24-31, 76-84, 99-106, 118-131, 139-150, 154-163, 188-194, 196-202, 217-222, 235-248, 261-267, 281-291, 295-302, 326-334, 357-364, 367-389, 397-410, 412-427, 441-454, 459-468, | 5-25, 42-105, 111-132, 154-301, 315-344, 354-391, 393-626, 634-719, 739-947 | 8 | 198-214, 305-368, 454-509 | 12 | 168 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 484-501, 536-542, 550-572, 586-595, 599-615, 667-676, 684-698, 721-727, 743-752, 759-772, 780-789, 792-809, 817-823, 835-841, 869-875, 882-889, 894-907, 926-938 | | | | | |
| NTHI0145 | hypothetical protein | 4-28, 43-53, 101-110, 112-125, 127-133, 218-228, 246-256, 276-282, 290-296, 306-313, 319-337, 347-354, 356-363, 369-377, 395-403, 421-429, 507-516, 518-528, 536-542, 556-570, 600-615, 617-629 | 1-156, 215-258, 304-350, 353-384, 388-456, 466-499, 501-575, 577-649 | 4 | 105-166, 461-553, 579-658 | 13 | 169 |
| NTHI0166 | homoserine kinase | 4-18, 20-30, 32-44, 49-57, 63-82, 84-90, 102-117, 145-173, 176-190, 193-199, 202-210, 213-223, 231-238, 240-253, 257-263, 270-293, 299-306 | 1-27, 29-137, 150-313 | 4 | 135-216, 243-268 | 14 | 170 |
| NTHI0193 | putative type I site-specific restriction-modification system, R subunit | 11-17, 35-51, 63-70, 75-80, 100-110, 113-128, 140-152, 159-175, 196-211, 222-233, 251-262, 264-272, 284-309, 311-319, 328-338, 356-365, 382-398, 404-420, 426-435, 462-469, 479-486, 506-514, 522-529, 532-539, 554-564, 575-584, 595-600, 605-617, 624-638, 662-670, 677-701, 714-734, 736-753, 781-793, 813-825, 836-852, 861-875, 911-916, 961-973, 981-991 | 1-15, 31-132, 139-242, 247-347, 354-396, 399-423, 425-444, 461-496, 499-640, 656-762, 779-862, 864-895, 908-1008 | 6 | 56-86, 370-395, 689-745 | 15 | 171 |
| NTHI0202 | hemin receptor | 6-23, 36-42, 52-58, 72-79, 102-108, 119-135, 186-194, 199-207, 231-238, 240-253, 263-270, 285-292, | 1-144, 146-235, 238-264, 269-302, 305-626, 629-745 | 3 | 150-212, 391-415, 460-527 | 16 | 172 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 313-321, 333-340, 347-353, 369-376, 399-407, 414-422, 431-437, 450-459, 468-487, 493-499, 506-517, 544-550, 565-571, 575-583, 589-597, 599-619, 682-704, 711-717, 723-729 | | | | | |
| NTHI0203 | 23S rRNA m(2)G2445 methyltransferase | 13-23, 26-38, 45-52, 54-65, 67-79, 81-94, 114-120, 127-143, 146-162, 173-186, 188-197, 200-207, 214-222, 254-262, 264-270, 278-286, 289-296, 302-310, 318-330, 338-356, 368-380, 421-454, 466-481, 484-493, 509-515, 517-526, 528-536, 551-558, 560-569, 588-593, 600-626, 641-648, 672-695, 702-708 | 1-28, 32-162, 167-233, 255-282, 284-300, 315-368, 388-427, 464-603, 615-684 | 5 | 113-143, 509-550 | 17 | 173 |
| NTHI0206 | hypothetical protein | 23-47, 49-58, 61-67, 88-106, 120-129, 132-142, 145-150, 161-170, 172-185, 199-211, 238-253 | 5-82, 85-114, 116-159, 162-256 | 8 | 39-137, 151-179, 182-253 | 18 | 174 |
| NTHI0208 | high-affinity zinc transporter periplasmic component | 4-18, 23-42, 45-79, 83-92, 95-118, 150-157, 167-189, 193-201, 216-222, 225-234, 250-266, 271-282, 284-291, 296-312, 317-324 | 1-121, 160-188, 198-214, 222-265 | 5 | 65-175, 244-302 | 19 | 175 |
| NTHI0210 | UDP-N-acetylmuramate:L-alanyl-gamma-D-glutamyl-meso-diaminopimelate ligase | 4-12, 25-30, 48-70, 76-85, 93-110, 133-139, 151-160, 172-187, 189-212, 214-222, 228-242, 259-280, 286-311, 315-321, 324-360, 371-391, 393-408, 414-424, 427-434, 440-449 | 1-40, 42-231, 247-452 | 5 | 72-113, 122-159, 206-251, 274-358, 370-399 | 20 | 176 |
| NTHI0225 | Outer membrane protein P2 precursor | 5-25, 36-42, 64-70, 84-91, 100-114, 116-122, 139-145, 162-176, 186-199, | 1-79, 94-194, 209-230, 235-351 | 7 | 111-265 | 21 | 177 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a] Haemophilus influenzae antigenic protein | [a] Putative function (by homology) | [b] Predicted immunogenic aa | [c] Predicted classII-restricted T cell epitope/regions | [d] No. of selected clones per ORF | [e] Location of identified immunogenic region (aa) | [f] SEQ ID NO (DNA) | [f] SEQ ID NO (protein) |
|---|---|---|---|---|---|---|---|
| NTHI0228 | N-acetylneuraminate lyase | 5-15, 39-46, 73-97, 99-125, 134-143, 157-166, 168-187, 195-204, 228-240, 247-270, 278-290 | 1-46, 57-89, 92-282 | 2 | 161-213, 248-278 | 22 | 178 |
| NTHI0239 | HflK | 56-61, 83-105, 112-128, 133-150, 166-185, 196-205, 215-221, 228-233, 237-246, 251-257, 302-309, 312-323, 325-336, 358-365, 371-382, 394-404 | 1-15, 29-70, 76-259, 266-286, 298-384, 388-408 | 26 | 11-37, 49-107, 263-297, 357-405 | 23 | 179 |
| NTHI0269 | formate acetyltransferase | 44-49, 71-76, 81-91, 97-103, 121-130, 133-140, 149-174, 184-195, 200-209, 229-236, 238-246, 260-270, 285-292, 305-315, 349-354, 358-363, 373-380, 387-402, 418-431, 442-450, 469-476, 490-516, 523-552, 559-570, 588-596, 608-627, 655-675 677-686, 704-711, 717-723, 738-753, 760-766 | 1-126, 130-228, 230-331, 338-377, 380-459, 467-638, 643-699, 712-764 | 5 | 157-255, 519-568, 583-649 | 24 | 180 |
| NTHI0291 | potassium efflux protein KefA | 201-209, 228-234, 241-264, 277-288, 314-336, 356-362 10-29, 35-43, 61-80, 88-94, 105-110, 129-138, 148-156, 168-175, 188-193, 195-204, 218-247, 285-293, 323-343, 350-367, 423-453, 467-474, 490-510, 536-565, 588-594, 598-604, 614-632, 643-650, 653-665, 667-674, 682-730, 737-746, 769-776, 784-824, 836-879, 885-898, 912-925, 932-956, 959-975, 979-986, 1002-1027, 1030-1037, 1039-1062, 1088-1095 | 1-58, 140-266, 282-375, 394-440, 446-1064, 1083-1103 | 9 | 13-107, 137-259, 827-849 | 25 | 181 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0306 | 3-dehydroquinate synthase | 13-22, 36-70, 79-90, 98-104, 106-137, 155-167, 178-194, 198-231, 247-256, 274-279, 286-305, 312-317, 322-344, 348-358 | 9-61, 68-138, 151-197, 200-362 | 9 | 293-326 | 26 | 182 |
| NTHI0321 | aerobic respiration control sensor protein ArcB | 20-95, 97-107, 119-129, 138-145, 153-165, 180-196, 211-219, 221-227, 232-241, 248-260, 262-268, 282-289, 304-313, 321-333, 349-358, 371-401, 412-424, 446-454, 474-491, 511-519, 526-534, 537-543, 558-579, 586-592, 604-610 | 1-117, 134-346, 359-400, 402-489, 510-582 | 5 | 168-228, 346-372, 556-570 | 27 | 183 |
| NTHI0334 | polynucleotide phosphorylase/polyadenylase | 4-20, 23-32, 38-47, 55-61, 90-104, 109-122, 124-145, 150-156, 158-164, 173-189, 201-221, 231-236, 242-248, 269-280, 290-307, 320-336, 348-355, 373-387, 407-430, 439-467, 473-480, 501-507, 518-525, 530-545, 548-554, 594-602, 612-623, 625-631, 633-642, 646-653, 658-679 | 1-356, 369-466, 468-544, 550-571, 582-610, 617-657, 661-698 | 7 | 67-82, 129-300, 437-498, 540-580 | 28 | 184 |
| NTHI0338 | putative soluble lytic transglycosylase fused to an ABC-type amino acid-binding protein | 4-9, 21-29, 48-53, 55-61, 82-93, 101-114, 144-153, 163-200, 207-214, 216-225, 241-256, 267-275, 282-292, 334-348, 356-372, 390-408, 415-422, 427-436 | 10-41, 58-78, 85-296, 299-403, 410-444 | 4 | 244-355 | 29 | 185 |
| NTHI0351 | S-adenosylmethionine:tRNA ribosyltransferase-isomerase | 11-18, 21-31, 43-50, 52-66, 77-84, 89-98, 106-111, 121-126, 128-137, 139-150, 152-160, 168-190, 206-216, 218-224, 229-249, 254-262, 264-274, 288-297, 299-325, 335-345 | 3-20, 33-83, 86-104, 115-160, 168-278, 280-363 | 3 | 245-278 | 30 | 186 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0354 | adhesion and penetration protein Hap | 5-24, 26-39, 46-57, 74-99, 118-124, 143-153, 194-206, 218-224, 246-251, 276-282, 329-337, 345-350, 355-361, 363-370, 372-378, 392-400, 415-423, 436-442, 448-461, 472-481, 509-516, 611-617, 621-627, 638-644, 661-672, 685-691, 694-699, 740-746, 789-809, 839-850, 893-900, 902-908, 914-920, 929-937, 957-967, 984-991, 998-1005, 1012-1035, 1061-1069, 1072-1092, 1106-1111, 1117-1123, 1125-1133, 1135-1149, 1173-1179, 1186-1191, 1223-1233, 1251-1257, 1259-1276, 1285-1297, 1315-1332, 1352-1373, 1383-1389 | 1-49, 68-107, 113-186, 194-216, 225-288, 292-313, 324-417, 419-454, 492-562, 575-813, 820-930, 955-998, 1009-1074, 1079-1097, 1103-1383 | 27 | 270-365, 467-487, 552-636, 663-742, 829-888, 968-1044, 1060-1115 | 31 | 187 |
| NTHI0358 | TonB | 5-25, 53-59, 87-93, 122-128, 161-166, 174-180, 202-210, 217-223, 231-243, 250-261 | 2-65, 83-101, 118-133, 171-212, 232-264 | 6 | 47-67, 134-207 | 32 | 188 |
| NTHI0363 | lipoprotein | 4-20, 37-55, 57-64, 73-85, 95-115, 146-154, 156-168, 181-186, 192-199 | 1-53, 67-128, 140-209 | 1 | 10-91 | 33 | 189 |
| NTHI0369 | heme-hemopexin utilization protein C | 5-34, 40-45, 49-67, 90-99, 105-132, 138-144, 160-165, 175-183, 187-193, 215-220, 278-303, 306-320, 323-330, 363-374, 405-429, 441-450, 476-482, 495-501, 515-524, 541-547, 573-582, 608-627, 629-666, 674-681 | 1-67, 79-97, 100-255, 259-304, 306-343, 348-479, 487-517, 522-579, 581-621, 624-705 | 5 | 28-99, 115-146, 228-295 | 34 | 190 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0370 | heme/hemopexin-binding protein B | 6-27, 60-66, 68-81, 86-100, 102-111, 126-137, 140-150, 163-171, 189-210, 214-221, 227-234, 263-269, 280-287, 295-302, 309-314, 318-328, 336-343, 350-356, 363-369, 381-390, 408-432, 449-461, 463-498, 506-530, 532-544 | 1-33, 65-402, 405-565 | 9 | 66-151, 192-261 | 35 | 191 |
| NTHI0371 | heme/hemopexin-binding protein A | 4-15, 34-42, 83-90, 106-112, 114-120, 124-134, 177-185, 197-203, 210-225, 273-281, 295-301, 318-326, 387-396, 423-428, 444-452, 515-522, 529-535, 559-565, 582-588, 594-604, 628-638, 708-717, 749-756, 798-810, 844-850, 860-866, 875-895, 911-917 | 1-25, 32-62, 82-139, 147-167, 173-353, 357-484, 486-519, 521-554, 557-687, 701-720, 730-779, 782-899 | 35 | 45-115, 776-916 | 36 | 192 |
| NTHI0374 | nitrate/nitrite sensor protein NarQ | 8-33, 51-59, 73-89, 92-103, 119-141, 149-172, 175-185, 197-202, 211-218, 223-233, 249-258, 268-289, 309-314, 319-333, 340-352, 356-362, 369-393, 403-415, 417-450, 459-483, 493-500, 510-516, 539-549, 557-564 | 5-297, 329-401, 417-511, 526-567 | 9 | 471-508, 544-563 | 37 | 193 |
| NTHI0375 | UDP-N-acetylenolpyruvoylglucosamine reductase | 4-13, 19-34, 39-46, 48-55, 57-66, 76-83, 89-94, 103-116, 123-140, 167-180, 184-196, 206-217, 231-238, 247-255, 257-276, 279-294, 300-328 | 1-338 | 7 | 234-310 | 38 | 194 |
| NTHI0382 | glutamyl-tRNA synthetase | 10-18, 20-32, 34-43, 48-53, 81-88, 104-115, 134-142, 146-154, 159-166, 179-184, 192-200, 205-212, 222-240, 252-260, 267-279, 296-306, | 1-98, 102-122, 144-238, 265-334, 347-380, 385-480 | 5 | 138-160, 365-461 | 39 | 195 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| <sup>a</sup>Haemophilus influenzae antigenic protein | <sup>a</sup>Putative function (by homology) | <sup>b</sup>Predicted immunogenic aa | <sup>c</sup>Predicted classII-restricted T cell epitope/ regions | <sup>d</sup>No. of selected clones per ORF | <sup>e</sup>Location of identified immunogenic region (aa) | <sup>f</sup>SEQ ID NO (DNA) | <sup>f</sup>SEQ ID NO (protein) |
|---|---|---|---|---|---|---|---|
| NTHI0407 | putative type IV pilin secretion protein | 322-337, 351-365, 397-409, 411-420, 436-446, 451-459, 462-469, 471-477 4-11, 20-25, 29-45, 60-90, 97-113, 117-131, 136-144, 149-158, 160-186, 198-211, 214-236, 244-290, 307-321, 324-331, 348-356, 365-376, 378-389 | 1-365, 369-406 | 2 | 8-40 | 40 | 196 |
| NTHI0408 | putative type IV pilin secretion protein | 4-13, 20-25, 33-45, 53-84, 86-99, 101-111, 120-129, 140-169, 175-185, 204-216, 220-226, 229-237, 248-265, 271-281, 300-310, 312-326, 342-348, 350-358, 364-378, 382-403, 405-413, 417-426, 443-449 | 1-20, 30-68, 73-293, 305-337, 339-441 | 2 | 420-464 | 41 | 197 |
| NTHI0448 | opacity associated protein | 29-44, 72-77, 79-89, 96-102, 118-124, 127-138, 140-167, 174-191, 227-232, 236-244, 252-258, 267-288, 290-298, 317-328, 332-344, 346-365, 385-392, 397-403 | 1-15, 24-57, 80-95, 121-180, 196-214, 228-307, 318-431 | 7 | 272-326, 347-429 | 42 | 198 |
| NTHI0458 | primosome assembly protein PriA | 4-37, 39-48, 59-75, 81-103, 139-147, 159-168, 204-226, 233-242, 245-266, 273-280, 286-291, 297-312, 314-321, 338-356, 373-380, 388-395, 405-411, 419-426, 431-472, 474-489, 500-511, 523-529, 532-541, 549-569, 575-585, 593-618, 620-626, 628-644, 650-664, 675-680, 687-695, 701-707, 715-727 | 1-56, 71-141, 156-250, 260-440, 447-467, 493-525, 531-653, 663-730 | 5 | 54-138, 322-353, 607-644, 651-709 | 43 | 199 |
| NTHI0463 | nitrate reductase | 21-39, 45-62, 65-71, 81-93, 118-124, 178-191, 200-205, 209-216, 223-228, 237-248, | 1-73, 76-118, 121-202, 206-254, 262-320, 326-358, 363-609, 617-638, 646-672, 712-728, | 5 | 13-61, 373-422, 450-528 | 44 | 200 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| $^a$Haemophilus influenzae antigenic protein | $^a$Putative function (by homology) | $^b$Predicted immunogenic aa | $^c$Predicted classII-restricted T cell epitope/ regions | $^d$No. of selected clones per ORF | $^e$Location of identified immunogenic region (aa) | $^f$SEQ ID NO (DNA) | $^f$SEQ ID NO (protein) |
|---|---|---|---|---|---|---|---|
| | | 252-268, 331-344, 350-364, 366-373, 382-420, 423-439, 457-465, 506-529, 549-555, 594-601, 605-612, 623-631, 645-657, 659-667, 687-692, 695-707, 716-727, 737-743, 749-760, 790-797, 803-810, 822-829 | 742-791, 797-821, | | | | |
| NTHI0472 | CMP-Neu5Ac--lipooligosaccharide alpha 2-3 sialyltransferase | 26-32, 38-58, 60-68, 70-90, 98-111, 116-139, 141-151, 158-169, 173-183, 199-206, 222-262, 270-290, 292-307 | 1-15, 17-176, 193-320 | 5 | 153-242 | 45 | 201 |
| NTHI0503 | cell envelope integrity inner membrane protein TolA | 12-37, 48-57, 80-86, 158-165, 171-178, 188-195, 322-331, 344-353, 360-366, 370-389, 396-405 | 4-77, 158-178, 319-377, 389-408 | 6 | 263-304, 323-407 | 46 | 202 |
| NTHI0510 | long-chain-fatty-acid--CoA ligase | 22-27, 30-36, 45-52, 60-68, 76-110, 112-132, 134-142, 144-150, 163-202, 206-213, 232-239, 254-285, 291-297, 305-314, 324-334, 340-346, 350-356, 364-379, 381-389, 408-414, 427-433, 439-445, 448-454, 458-470, 473-497, 500-507, 516-531, 544-550 | 16-209, 222-390, 405-529, 537-562 | 8 | 53-83, 218-245, 316-357, 391-415 | 47 | 203 |
| NTHI0522 | long-chain fatty acid ABC transporter | 5-17, 23-33, 48-55, 58-65, 69-76, 89-100, 107-128, 160-191, 197-202, 208-218, 220-238, 259-270, 280-286, 293-321, 326-332, 351-375, 402-425, 446-455 | 2-39, 45-232, 243-281, 298-384, 386-458 | 15 | 152-241, 314-353 | 48 | 204 |
| NTHI0525 | putative cell cycle protein MesJ | 4-14, 17-26, 28-61, 68-90, 104-124, 129-135, 140-146, 148-155, 158-167, 210-236, 238-244, 246-267, 279-292, 298-308, 310-328, 351-364, | 13-68, 76-92, 98-172, 174-226, 233-316, 323-342, 346-392, 402-429 | 8 | 2-19, 87-117, 134-234, 242-292, 376-403 | 49 | 205 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0529 | high-affinity zinc uptake system membrane protein ZnuB | 368-375, 377-385, 395-402, 408-414, 418-427 4-30, 35-73, 82-114, 116-163, 171-201, 220-238, 240-256 | 1-261 | 3 | 201-228 | 50 | 206 |
| NTHI0532 | metalloprotease | 4-9, 18-40, 91-99, 101-110, 112-126, 139-148, 150-175, 185-191, 206-212, 217-223, 243-259, 264-272, 284-290, 296-302, 319-332, 340-364, 369-376, 380-386, 391-408, 426-433, 440-449, 460-467 | 1-46, 51-83, 90-131, 140-281, 290-311, 315-355, 376-472 | 12 | 105-137, 200-231, 289-358 | 51 | 207 |
| NTHI0567 | penicillin-binding protein 1A | 4-50, 66-84, 92-111, 126-134, 142-149, 159-186, 199-205, 223-228, 241-256, 261-267, 284-295, 336-343, 345-357, 362-368, 387-393, 406-420, 426-433, 445-482, 502-508, 527-534, 539-557, 572-580, 588-609, 624-629, 644-654, 677-696, 735-742, 745-755, 791-801, 806-812, 819-824, 838-844 | 1-83, 93-120, 123-188, 193-238, 242-571, 583-604, 609-629, 649-729, 733-796, 815-861 | 6 | 302-436, 547-576, 683-747 | 52 | 208 |
| NTHI0573 | PTS system, fructose-specific IIBC component | 4-9, 14-27, 29-38, 40-67, 70-81, 85-120, 125-131, 153-174, 222-231, 233-251, 272-295, 297-308, 318-376, 391-403, 416-431, 437-446, 466-503, 509-550 | 1-140, 170-195, 218-556 | 5 | 115-180, 459-572, 496-537 | 53 | 209 |
| NTHI0574 | 1-phosphofructokinase | 4-19, 24-30, 32-39, 41-60, 79-85, 102-151, 153-185, 191-211, 217-223, 236-242, 244-251, 258-264, 274-309 | 1-99, 101-207, 212-248, 251-303 | 4 | 76-100, 266-286 | 54 | 210 |
| NTHI0585 | autotransported protein Lav | 48-71, 100-106, 110-126, 133-139, 143-150, 166-174, 186-199, 212-221, 223-233, 235-259, 261-269, 281-286, | 40-115, 120-142, 145-240, 258-343, 347-461, 465-507, 526-549, 558-700 | 20 | 57-100, 201-256, 622-665, 683-699 | 55 | 211 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| <sup>a</sup>Haemophilus influenzae antigenic protein | <sup>a</sup>Putative function (by homology) | <sup>b</sup>Predicted immunogenic aa | <sup>c</sup>Predicted classII-restricted T cell epitope/ regions | <sup>d</sup>No. of selected clones per ORF | <sup>e</sup>Location of identified immunogenic region (aa) | <sup>f</sup>SEQ ID NO (DNA) | <sup>f</sup>SEQ ID NO (protein) |
|---|---|---|---|---|---|---|---|
| | | 298-304, 312-318, 323-330, 347-360, 376-386, 400-408, 410-418, 436-443, 445-452, 460-467, 477-483, 510-521, 526-537, 564-571, 579-595, 605-652, 667-684, 692-698 | | | | | |
| NTHI0588 | survival protein SurA-like protein | 5-22, 28-44, 58-72, 74-80, 84-91, 99-111, 135-140, 142-151, 171-185, 189-198, 208-220, 226-244, 247-253, 260-268, 283-290 | 1-27, 35-52, 60-143, 165-213, 228-272, 281-313 | 7 | 21-204, 279-303 | 56 | 212 |
| NTHI0625 | ATP-dependent protease ATP-binding subunit | 7-20, 24-31, 41-51, 68-84, 88-102, 108-114, 132-139, 174-184, 200-206, 220-226, 242-248, 250-257, 260-266, 279-289, 300-339, 346-359, 374-383, 420-433 | 1-15, 21-124, 140-231, 248-370, 379-396, 408-428 | 5 | 160-210, 221-283 | 57 | 213 |
| NTHI0630 | D-ribose transporter ATP binding protein | 4-35, 46-53, 80-94, 122-145, 149-165, 180-186, 193-217, 221-228, 244-251, 254-263, 268-286, 295-306, 327-333, 339-346, 353-359, 375-381, 401-407, 412-419, 432-438, 445-450, 454-467, 484-490 | 1-250, 254-313, 336-395, 403-479 | 5 | 94-144, 420-445 | 58 | 214 |
| NTHI0645 | nucleoside permease | 4-21, 27-61, 63-69, 75-85, 87-131, 143-159, 167-174, 179-186, 189-217, 236-241, 249-278, 283-306, 321-347, 351-361, 363-372, 384-397, 405-414 | 1-145, 150-216, 236-417 | 4 | 151-177, 179-250 | 59 | 215 |
| NTHI0652 | ribonuclease I | 4-21, 32-39, 42-48, 70-82, 93-113, 119-129, 136-142, 149-178, 180-185, 191-204, 210-218, 237-243, 247-255 | 1-27, 71-115, 131-157, 164-264 | 3 | 82-147, 166-247 | 60 | 216 |
| NTHI0668 | co-chaperonin GroES | 4-14, 23-30, 37-46, 54-68, 81-87 | 1-17, 19-49, 54-79 | 5 | 11-32 | 61 | 217 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0670 | 50S ribosomal protein L9 | 4-24, 27-39, 59-67, 69-82, 99-120, 127-146 | 1-17, 23-44, 56-149 | 9 | 5-149 | 62 | 218 |
| NTHI0716 | periplasmic negative regulator of sigmaE | 4-26, 44-52, 71-78, 87-98, 110-118, 123-135, 144-151, 154-161, 166-171, 180-193, 201-212, 227-241, 249-257, 259-267, 281-289, 296-312 | 1-29, 38-243, 251-278, 290-314 | 5 | 126-154 | 63 | 219 |
| NTHI0739 | C4-dicarboxylate transporter | 4-23, 27-42, 60-139, 141-149, 171-183, 187-203, 209-215, 220-247, 249-255, 261-285, 296-313, 316-326, 339-346, 353-374, 379-385, 391-412, 418-428 | 1-207, 215-324, 326-431 | 3 | 115-195, 274-381 | 64 | 220 |
| NTHI0741 | bifunctional 2',3'-cyclic nucleotide 2'-phosphodiesterase/3'-nucleotidase periplasmic precursor protein | 7-21, 31-49, 65-71, 77-85, 94-100, 108-114, 132-155, 162-174, 181-197, 208-221, 228-236, 250-272, 286-293, 304-313, 318-333, 337-342, 347-357, 359-367, 374-383, 385-418, 445-460, 465-473, 498-508, 520-526, 528-535, 537-551, 567-573, 581-588, 604-609, 624-634, 646-654 | 1-83, 96-114, 123-243, 246-334, 346-424, 435-469, 487-537, 541-567, 578-647 | 8 | 41-153, 434-554, 593-644 | 65 | 221 |
| NTHI0745 | 30S ribosomal protein S12 | 5-11, 13-40, 49-56, 75-84, 87-107, 116-121 | 1-30, 32-65, 68-121 | 13 | 85-112 | 66 | 222 |
| NTHI0762 | bifunctional N-acetylglucosamine-1-phosphate uridyltransferase/glucosamine-1-phosphate acetyltransferase | 5-13, 21-31, 33-46, 49-56, 71-78, 81-92, 98-111, 115-120, 125-134, 148-155, 169-177, 181-186, 195-205, 209-218, 229-238, 245-257, 273-279, 286-306, 308-318, 326-333, 335-342, 345-353, 360-370, 379-387, 398-418, 434-445 | 3-116, 120-267, 278-339, 341-380, 396-427, 430-450 | 3 | 235-250 | 67 | 223 |
| NTHI0779 | ABC transporter ATP-binding protein | 40-50, 74-87, 91-98, 111-120, 127-136, 145-150, 157-174, 179-204, 209-221, 233-246, | 1-17, 19-97, 116-137, 141-383, 386-536, 552-621 | 4 | 20-57, 546-566 | 68 | 224 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| a Haemophilus influenzae antigenic protein | a Putative function (by homology) | b Predicted immunogenic aa | c Predicted classII-restricted T cell epitope/regions | d No. of selected clones per ORF | e Location of identified immunogenic region (aa) | f SEQ ID NO (DNA) | f SEQ ID NO (protein) |
|---|---|---|---|---|---|---|---|
| NTHI0782 | hemoglobin-haptoglobin binding protein B | 252-265, 288-297, 300-316, 326-348, 356-392, 397-408, 414-426, 429-435, 441-459, 473-492, 499-507, 561-570, 604-620 9-30, 72-78, 93-108, 185-192, 196-211, 222-228, 232-239, 274-282, 290-299, 305-313, 370-380, 442-451, 500-512, 540-547, 574-590, 596-613, 617-637, 640-655, 657-669, 699-709, 711-722, 736-745, 784-790, 795-801, 803-811, 815-822, 825-831, 841-847, 865-879, 885-892, 918-934, 937-943 | 1-41, 49-109, 121-164, 182-296 300-338, 346-368, 371-389, 402-448, 450-514, 520-589, 600-679, 684-992 | 17 | 1-29, 47-98, 190-276, 344-462, 489-527, 541-613, 709-747, 832-845 | 69 | 225 |
| NTHI0816 | Outer membrane protein P4, NADP phosphatase | 10-24, 37-44, 53-76, 78-85, 120-127, 134-144, 169-176, 193-201, 219-224, 262-271 | 1-266 | 9 | 29-151, 235-272 | 70 | 226 |
| NTHI0830 | lipoprotein | 4-21, 34-41, 85-106, 109-119, 156-173, 178-192, 198-211, 216-223, 248-263, 273-287, 315-321, 323-331, 338-343, 355-367, 382-389, 393-402 | 1-43, 48-111, 117-222, 235-309, 312-362, 366-403 | 45 | 18-351 | 71 | 227 |
| NTHI0834 | DNA mismatch repair protein | 15-21, 25-31, 37-42, 47-54, 72-96, 107-118, 121-127, 132-139, 154-161, 167-182, 190-196, 206-215, 224-244, 250-271, 291-301, 304-321, 323-348, 354-362, 370-402, 406-430, 446-451, 468-495, 502-508, 513-528, 530-581, 587-597, 599-606, 608-615, 628-646, 681-686, 688-696, 705-716, 718-742, | 8-97, 104-158, 178-281, 293-324, 340-432, 434-528, 531-581, 592-663, 666-706, 709-787, 792-809, 844-861 | 6 | 136-200, 266-279, 359-417, 598-663, 692-740 | 72 | 228 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI0870 | L-fuculokinase | 746-752, 759-767, 770-797, 805-813, 821-826, 844-858 4-9, 24-31, 42-47, 54-62, 65-72, 74-85, 97-112, 120-127, 137-156, 158-166, 197-204, 220-230, 233-244, 246-253, 257-263, 280-286, 294-327, 371-379, 386-407, 410-416, 422-440, 444-450 | 1-22, 25-68, 70-214, 216-245, 254-282, 292-330, 347-404, 407-470 | 5 | 304-323, 445-463 | 73 | 229 |
| NTHI0921 | murein transglycosylase C | 4-19, 37-43, 54-71, 74-80, 84-90, 98-107, 118-139, 142-158, 167-195, 203-210, 218-228, 230-237, 254-259, 266-277, 300-307, 314-319, 323-337, 340-349 | 1-38, 52-357 | 4 | 42-177, 196-324 | 74 | 230 |
| NTHI0945 | 30S ribosomal protein S3 | 4-18, 49-55, 63-78, 87-109, 112-123, 135-141, 146-156, 171-179, 192-203, 210-219 | 1-105, 109-235 | 21 | 199-233 | 75 | 231 |
| NTHI0960 | 50S ribosomal protein L15 | 55-61, 70-80, 86-95, 102-128 | 1-15, 49-139 | 3 | 5-19 | 76 | 232 |
| NTHI1012 | thiol:disulfide interchange protein DsbA | 4-24, 28-39, 41-59, 64-88, 96-102, 105-116, 129-136, 151-162, 164-178, 189-202 | 1-111, 118-205 | 1 | 53-182 | 77 | 233 |
| NTHI1024 | DNA polymerase I | 5-29, 40-64, 90-99, 101-112, 114-135, 142-148, 166-183, 190-196, 201-208, 215-227, 233-239, 244-253, 261-269, 273-282, 335-341, 352-359, 370-378, 384-397, 403-416, 432-442, 445-453, 465-474, 489-497, 508-529, 533-542, 547-553, 564-584, 589-604, 617-634, 636-642, 656-669, 702-719, 742-752, 764-771, 774-783, | 1-87, 89-135, 138-166, 169-194, 198-219, 222-240, 243-390, 403-489, 499-571, 575-614, 624-900, 906-924 | 10 | 401-430, 541-680 818-854 | 78 | 234 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII- restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI1028 | ClpB | 790-804, 814-821, 823-831, 843-848, 866-874, 879-890, 910-923 11-22, 29-41, 44-62, 69-75, 80-97, 107-116, 123-130, 136-143, 161-169, 177-182, 190-196, 201-208, 211-223, 234-249, 259-265, 272-279, 297-303, 305-314, 333-341, 344-352, 358-381, 387-400, 417-429, 469-477, 502-512, 536-549, 576-583, 599-607, 611-625, 640-656, 668-696, 710-717, 736-750, 758-765, 772-781, 790-814, 829-846 | 1-102, 104-139, 158-208, 214-292, 302-391, 397-474, 497-550, 554-856 | 17 | 273-344, 441-500, 643-690 | 79 | 235 |
| NTHI1030 | ribonuclease R | 8-14, 28-36, 74-79, 83-100, 105-110, 115-120, 128-139, 147-155, 158-164, 169-177, 182-188, 197-205, 214-221, 233-239, 242-255, 271-279, 288-295, 301-322, 329-343, 345-365, 369-384, 387-396, 405-428, 454-460, 463-475, 486-495, 504-514, 526-533, 539-557, 562-575, 582-596, 638-648, 655-673, 675-683, 710-724, 749-756, 765-776 | 1-21, 29-216, 235-291, 294-350, 355-521, 535-606, 610-632, 648-745, 747-782 | 7 | 160-194, 350-389, 479-508, 620-650 | 80 | 236 |
| NTHI1034 | CMP-neu5Ac-- lipooligosaccharide alpha 2-3 sialyltransferase | 4-9, 31-37, 43-63, 65-73, 75-95, 103-114, 120-154, 161-172, 176-186, 202-209, 225-258, 273-293, 295-310 | 22-179, 196-326 | 5 | 32-76 | 81 | 237 |
| NTHI1048 | thiol:disulfide interchange protein precursor | 4-15, 27-41, 47-53, 56-64, 66-73, 75-90, 92-104, 118-153, 157-164, 168-176, 179-209, 218-229, 231-281, 308-332, | 1-51, 63-84, 89-120, 130-321, 328-478, 482-504, 509-579 | 6 | 45-82, 315-337, 351-448 | 82 | 238 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 335-356, 373-395, 401-415, 423-442, 460-466, 485-501, 506-524, 541-551 | | | | | |
| NTHI1059 | putative membrane-fusion protein | 11-35, 37-45, 53-62, 66-73, 81-86, 92-100, 105-116, 121-145, 158-182, 186-207, 213-221, 224-233, 246-254, 259-267, 274-279, 283-289, 293-304, 309-317, 332-343, 348-354, 376-382, 384-393 | 8-54, 60-254, 267-320, 325-348, 375-398 | 14 | 54-179 | 83 | 239 |
| NTHI1063 | multidrug resistance protein A | 23-47, 58-72, 83-92, 109-141, 144-150, 160-172, 183-196, 222-249, 269-278, 300-306, 313-328, 336-348, 377-384 | 4-77, 84-257, 260-285, 294-384 | 2 | 109-205 | 84 | 240 |
| NTHI1083 | Outer membrane protein 26 | 4-21, 26-48, 52-65, 69-77, 79-87, 160-176, 181-191 | 1-46, 59-98, 127-197 | 19 | 40-123, 132-158 | 85 | 241 |
| NTHI1084 | protective surface antigen D15 | 4-12, 16-27, 29-35, 37-49, 58-68, 78-96, 119-126, 132-155, 162-167, 174-179, 186-191, 216-225, 238-244, 249-255, 261-268, 280-290, 316-325, 333-341, 343-349, 375-384, 408-415, 435-444, 449-456, 477-485, 508-516, 522-528, 544-549, 580-586, 588-594, 600-628, 638-644, 662-668, 698-710, 717-727, 744-750, 767-782, 790-797 | 1-194, 196-239, 246-427, 429-461, 469-591, 594-800 | 2 | 186-247 | 86 | 242 |
| NTHI1085 | zinc metalloprotease | 4-26, 28-40, 42-49, 57-72, 76-82, 90-144, 148-154, 165-170, 178-183, 209-214, 221-232, 247-257, 280-286, 294-305, 313-323, 329-341, 353-358, 366-384, 386-405, 413-440 | 1-82, 86-144, 156-202, 206-237, 240-255, 258-276, 287-442 | 4 | 42-141, 224-251, 292-344 | 87 | 243 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI1093 | glycyl-tRNA synthetase subunit beta | 5-10, 16-26, 37-43, 51-65, 74-81, 97-103, 114-120, 131-145, 153-167, 175-183, 198-218, 225-231, 237-246, 248-264, 268-280, 286-291, 296-307, 320-326, 339-361, 369-374, 389-396, 425-431, 444-456, 476-495, 497-503, 505-513, 536-542, 546-553, 555-562, 574-586, 595-607, 609-618, 621-629, 636-665, 667-691, 699-719 | 1-34, 40-84, 109-192, 199-240, 247-352, 391-425, 428-632, 634-665, 667-722 | 13 | 53-152, 172-255, 540-659 | 88 | 244 |
| NTHI1094 | hypothetical protein | 4-27, 35-42, 88-94, 114-121, 123-129 | 1-27, 29-138 | 4 | 22-89 | 89 | 245 |
| NTHI1114 | transcriptional regulator NrdR | 13-26, 31-37, 44-52, 68-82, 84-96, 104-111, 118-135 | 6-35, 40-65, 82-139 | 10 | 3-102 | 90 | 246 |
| NTHI1127 | deoxyuridine 5'-triphosphate nucleotidohydrolase | 4-11, 29-38, 47-72, 74-90, 93-98, 113-130 | 1-35, 50-143 | 5 | 65-91 | 91 | 247 |
| NTHI1145 | acetyl-CoA carboxylase biotin carboxylase subunit | 14-24, 26-34, 39-85, 100-112, 125-135, 151-160, 169-175, 209-217, 221-228, 236-243, 257-268, 305-323, 330-336, 346-351, 354-391, 417-425, 437-442 | 1-92, 103-134, 148-238, 246-264, 271-300, 307-335, 348-415, 424-448 | 6 | 102-156, 204-246, 331-384 | 92 | 248 |
| NTHI1160 | 2-isopropylmalate synthase | 4-10, 18-52, 55-64, 67-76, 82-110, 115-127, 149-158, 165-178, 182-190, 193-206, 215-221, 224-230, 241-248, 266-280, 283-291, 293-299, 334-340, 353-364, 367-382, 390-399, 405-414, 430-443, 462-471, 476-512 | 1-43, 49-138, 153-169, 172-222, 238-340, 355-372, 385-423, 427-515 | 6 | 126-149, 225-378 | 93 | 249 |
| NTHI1164 | IgA-specific serine endopeptidase | 8-31, 33-38, 47-55, 65-72, 74-104, 169-181, 197-207, 224-231, 233-241, 243-249, 268-274, 280-287, 316-323, 326-333, 338-344, 401-407, | 1-108, 111-152, 193-212, 218-250, 262-291, 305-440, 450-492, 503-647, 657-730, 732-752, 762-975, 985-1055, 1058-1076, 1082-1099, | 52 | 168-451, 560-701, 708-740, 864-924, 967-1147, 1158-1252, 1294-1332, 1342-1396, 1416-1471, 1630-1674, 1766-1774 | 94 | 250 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| $^a$Haemophilus influenzae antigenic protein | $^a$Putative function (by homology) | $^b$Predicted immunogenic aa | $^c$Predicted classII-restricted T cell epitope/ regions | $^d$No. of selected clones per ORF | $^e$Location of identified immunogenic region (aa) | $^f$SEQ ID NO (DNA) | $^f$SEQ ID NO (protein) |
|---|---|---|---|---|---|---|---|
| | | 460-466, 470-476, 479-484, 487-492, 500-512, 519-536, 543-549, 595-608, 615-621, 624-642, 648-654, 730-741, 765-771, 809-816, 819-827, 829-837, 898-914, 949-956, 990-998, 1015-1021, 1044-1049, 1058-1072, 1119-1124, 1200-1206, 1246-1254, 1269-1276, 1292-1298, 1300-1305, 1307-1313, 1326-1332, 1354-1369, 1399-1405, 1419-1426, 1430-1440, 1477-1483, 1497-1505, 1520-1538, 1562-1571, 1584-1596, 1613-1620, 1626-1633, 1668-1693, 1695-1719, 1721-1728, 1756-1774, 1785-1791 | 1196-1214, 1221-1236, 1243-1263, 1292-1312, 1427-1447, 1495-1648, 1650-1735, 1749-1785 | | | | |
| NTHI1168 | transferrin-binding protein 1 | 6-24, 50-57, 82-89, 96-103, 120-128, 130-144, 157-166, 180-188, 216-224, 241-258, 267-273, 276-293, 296-304, 330-339, 389-399, 403-411, 421-428, 432-438, 440-449, 459-466, 493-500, 506-514, 540-562, 568-576, 592-607, 628-634, 636-644, 666-672, 703-710, 729-739, 751-757, 759-767, 770-796, 840-875, 882-888 | 1-31, 61-100, 107-171, 173-190, 194-294, 298-337, 355-372, 383-529, 538-912 | 11 | 5-35, 41-68, 86-110, 233-359, 365-388, 504-610, 789-858 | 95 | 251 |
| NTHI1169 | transferrin-binding protein 2 precursor | 4-19, 53-61, 65-71, 87-94, 127-138, 154-164, 171-180, 195-200, 229-234, 244-250, 264-273, 321-327, | 5-54, 59-155, 157-231, 233-290, 308-329, 342-423, 429-600, 611-630 | 19 | 4-112, 163-211, 234-366, 384-453, 549-621 | 96 | 252 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 345-351, 388-402, 409-415, 423-437, 453-462, 464-482, 482, 548-555, 575-580, 601-608, 614-622 | | | | | |
| NTHI1175 | putative inner membrane protein translocase component YidC | 5-23, 28-33, 42-49, 69-78, 81-93, 111-119, 149-158, 161-171, 175-181, 189-204, 246-259, 266-272, 279-294, 321-327, 329-347, 349-371, 413-449, 451-477, 479-485, 493-530 | 1-35, 49-129, 157-213, 220-297, 303-541 | 2 | 112-146, 174-213 | 97 | 253 |
| NTHI1188 | biotin synthase | 8-46, 50-59, 67-78, 85-101, 107-113, 126-141, 160-165, 170-178, 187-193, 195-205, 217-226, 228-243, 257-265, 268-275, 287-292, 299-307, 316-324 | 1-176, 187-318 | 9 | 44-87, 150-241 | 98 | 254 |
| NTHI1199 | ATPase | 12-18, 23-30, 35-50, 54-61, 66-72, 75-81, 87-122, 125-159, 162-173, 178-186, 194-206, 213-236, 254-273, 286-292, 311-322, 324-330, 335-340, 344-353, 362-368, 372-379, 388-397 | 5-132, 134-247, 252-330, 340-380, 385-400 | 6 | 151-180, 223-302 | 99 | 255 |
| NTHI1207 | anaerobic dimethyl sulfoxide reductase chain A precursor | 10-33, 47-67, 88-98, 136-141, 181-192, 197-207, 224-231, 244-250, 259-264, 285-314, 329-335, 356-363, 389-406, 415-425, 428-438, 460-472, 474-482, 514-523, 531-565, 619-624, 632-637, 641-652, 661-675, 683-697, 704-711, 744-763, 775-785, 798-803 | 1-203, 205-274, 282-373, 383-574, 578-597, 599-761, 773-793 | 7 | 3-64, 320-350, 540-630, 751-789 | 100 | 256 |
| NTHI1231 | ATP-dependent RNA helicase HrpA | 23-35, 37-43, 45-82, 93-99, 117-123, 133-141, 157-163, 170-180, 191-202, 205-219, 228-248, 253-263, | 1-32, 36-82, 95-126, 129-368, 400-433, 438-760, 762-783, 787-868, 872-986, 991-1032, 1038-1194, | 7 | 660-691, 704-727, 755-774, 895-958 | 101 | 257 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| ᵃHaemophilus influenzae antigenic protein | ᵃPutative function (by homology) | ᵇPredicted immunogenic aa | ᶜPredicted classII-restricted T cell epitope/ regions | ᵈNo. of selected clones per ORF | ᵉLocation of identified immunogenic region (aa) | ᶠSEQ ID NO (DNA) | ᶠSEQ ID NO (protein) |
|---|---|---|---|---|---|---|---|
| | | 295-307, 319-327, 330-344, 355-369, 378-390, 408-424, 428-435, 441-450, 453-458, 466-481, 483-508, 534-547, 562-569, 576-584, 599-616, 622-628, 630-643, 645-657, 672-683, 693-718, 725-736, 750-759, 767-773, 784-791, 821-826, 836-844, 853-866, 879-893, 896-926, 932-937, 945-950, 952-958, 981-990, 994-1011, 1015-1028, 1030-1036, 1041-1047, 1050-1068, 1074-1103, 1127-1145, 1159-1181, 1186-1197, 1201-1206, 1214-1235, 1250-1269 | 1201-1278 | | | | |
| NTHI1238 | CTP synthase | 5-31, 33-39, 41-48, 57-64, 96-102, 110-120, 125-131, 133-144, 147-167, 170-184, 192-213, 223-254, 257-271, 276-290, 298-315, 320-331, 335-352, 373-396, 407-417, 443-452, 474-481, 483-491, 494-517, 525-536 | 1-28, 32-58, 67-259, 273-339, 351-426, 429-462, 465-512, 526-545 | 6 | 175-201, 398-477 | 102 | 258 |
| NTHI1244 | UDP-N-acetylglucosamine 1-carboxyvinyltransferase | 4-10, 12-19, 23-47, 54-63, 70-76, 82-91, 96-134, 136-172, 191-197, 222-234, 238-246, 248-255, 261-267, 272-278, 311-318, 352-362, 364-386, 391-398, 408-413 | 1-130, 138-185, 193-214, 224-262, 276-353, 362-421 | 1 | 87-142 | 103 | 259 |
| NTHI1253 | cytochrome c biogenesis protein CcmA | 4-15, 17-28, 32-38, 45-58, 78-93, 100-106, 117-126, 131-139, 143-162, 171-180, 185-209 | 3-133, 144-163, 171-201 | 3 | 56-203 | 104 | 260 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI1265 | NAD-dependent DNA ligase LigA | 17-33, 36-53, 59-84, 92-97, 100-130, 153-163, 205-211, 218-229, 241-272, 286-295, 298-306, 309-317, 319-331, 338-357, 373-394, 401-418, 424-436, 440-447, 460-481, 510-519, 545-566, 569-590, 599-607, 617-641, 646-651, 653-662 | 1-174, 176-196, 202-260, 264-322, 325-430, 435-458, 470-543, 547-579, 590-646 | 4 | 17-69, 104-227 | 105 | 261 |
| NTHI1266 | cell division protein ZipA | 4-23, 83-91, 98-104, 120-127, 162-171, 173-181, 200-209, 217-231, 237-255, 272-282, 297-310 | 1-48, 52-68, 95-124, 130-178, 195-307 | 10 | 30-173 | 106 | 262 |
| NTHI1286 | oligopeptide transport ATP-binding protein | 8-21, 27-49, 51-58, 65-75, 80-86, 103-113, 121-142, 145-159, 166-209, 215-239, 246-252, 258-272, 280-286, 288-307, 312-317, 323-329 | 3-273, 292-331 | 7 | 62-139 | 107 | 263 |
| NTHI1292 | periplasmic oligopeptide-binding protein | 4-26, 31-38, 56-70, 94-99, 109-140, 163-196, 212-217, 238-248, 252-257, 267-280, 282-290, 324-331, 334-341, 345-355, 367-373, 378-387, 394-401, 411-417, 432-438, 498-522, 529-538 | 1-49, 55-75, 88-105, 108-150, 159-189, 200-226, 232-258, 279-366, 369-433, 444-469, 478-492, 495-541 | 2 | 212-267 | 108 | 264 |
| NTHI1299 | peptidoglycan synthetase FtsI | 31-38, 46-68, 84-93, 100-115, 130-135, 154-168, 176-182, 187-202, 217-223, 236-241, 249-255, 261-267, 280-300, 326-346, 359-369, 384-395, 410-421, 433-441, 443-482, 486-498, 506-512, 524-551, 559-569, 572-583, 596-602 | 1-132, 139-191, 206-243, 248-321, 323-363, 369-410, 412-587, 592-610 | 5 | 289-301, 336-380, 507-567 | 109 | 265 |
| NTHI1300 | UDP-N-acetylmuramoylalanyl-D-glutamate--2,6-diaminopimelate ligase | 4-11, 31-42, 50-64, 68-101, 105-112, 120-136, 146-152, 158-169, 178-199, 206-212, | 1-363, 419-484 | 5 | 96-186 | 110 | 266 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 232-237, 247-257, 273-281, 292-303, 305-330, 332-338, 345-359, 361-371, 373-382, 393-400, 403-409, 421-427, 434-451, 453-461, 465-485 | | | | | |
| NTHI1308 | D-alanine--D-alanine ligase | 6-14, 26-37, 39-45, 78-94, 109-123, 127-146, 148-172, 185-207, 211-216, 222-229, 236-251, 255-261, 266-272, 280-303 | 5-24, 28-47, 52-76, 82-149, 165-185, 191-211, 231-306 | 4 | 34-92, 239-306 | 111 | 267 |
| NTHI1323 | Na+/dicarboxylate symporter | 4-20, 27-55, 59-89, 96-137, 141-168, 179-199, 216-241, 249-299, 304-311, 341-384, 389-414 | 1-204, 207-310, 312-440 | 10 | 15-146, 159-182, 296-352, 393-434 | 112 | 268 |
| NTHI1326 | cysteine/glutathione ABC transporter membrane/ATP-binding component | 6-14, 26-52, 59-72, 76-83, 89-97, 99-112, 130-162, 164-186, 199-209, 241-276, 282-310, 321-336, 343-351, 353-372, 376-385, 392-405, 425-437, 441-447, 470-476, 483-516, 519-529, 545-554, 558-563, 567-582 | 1-306, 321-385, 390-473, 484-586 | 5 | 307-440 | 113 | 269 |
| NTHI1332 | Outer membrane protein P5 | 5-22, 29-35, 66-76, 111-147, 162-185, 187-193, 224-233, 241-248, 253-281, 289-295, 299-316, 329-335, 337-348, 350-356 | 2-109, 125-161, 168-252, 263-357 | 8 | 4-20, 120-163, 256-358 | 114 | 270 |
| NTHI1342 | opacity protein | 4-22, 45-53, 74-84, 90-98, 119-133, 162-167 | 1-28, 46-66, 68-170 | 8 | 17-55, 68-170 | 115 | 271 |
| NTHI1390 | heme utilization protein | 4-15, 33-40, 67-78, 85-91, 102-116, 137-143, 153-159, 177-182, 209-216, 218-224, 233-243, 251-258, 286-294, 340-354, 356-363, 371-376, 450-457, 480-486, 507-518, 523-531, 533-548, 552-558, 566-572, 579-599, 612-618, | 1-30, 34-112, 134-233, 242-276, 278-319, 330-364, 369-738, 747-844, 867-887, 891-915 | 22 | 28-296, 382-435, 482-529, 629-692 | 116 | 272 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| $^a$Haemophilus influenzae antigenic protein | $^a$Putative function (by homology) | $^b$Predicted immunogenic aa | $^c$Predicted classII-restricted T cell epitope/ regions | $^d$No. of selected clones per ORF | $^e$Location of identified immunogenic region (aa) | $^f$SEQ ID NO (DNA) | $^f$SEQ ID NO (protein) |
|---|---|---|---|---|---|---|---|
| | | 631-636, 646-659, 662-671, 674-681, 689-703, 717-724, 750-762, 815-822, 827-853, 855-862, 870-886, 895-901, 906-912 | | | | | |
| NTHI1403 | phosphoenolpyruvate carboxylase | 53-61, 68-82, 94-111, 119-138, 146-152, 154-164, 175-185, 214-223, 233-246, 264-272, 276-289, 304-317, 322-330, 339-345, 352-368, 372-391, 411-417, 426-433, 436-442, 454-476, 479-507, 517-524, 554-567, 571-577, 590-601, 619-647, 660-673, 676-683, 690-698, 708-717, 725-734, 736-743, 766-772, 782-795, 805-816, 818-828, 835-848, 856-867 | 1-52, 54-107, 123-257, 261-404, 414-578, 589-663, 674-702, 705-744, 752-854, 857-879 | 5 | 335-407, 581-591, 680-745 | 117 | 273 |
| NTHI1423 | aromatic amino acid aminotransferase | 4-17, 31-38, 79-84, 107-113, 159-169, 171-184, 196-201, 206-218, 227-233, 235-243, 256-264, 268-286, 291-300, 321-331, 364-372, 386-393 | 1-28, 41-396 | 6 | 4-53 | 118 | 274 |
| NTHI1448 | HMW2C, putative glycosyltransferase involved in glycosylation of HMW1A and HMW2A | 12-19, 27-44, 51-62, 77-113, 119-140, 165-175, 190-204, 208-230, 237-251, 263-273, 278-283, 291-298, 302-308, 317-328, 352-371, 379-385, 387-400, 405-421, 423-460, 470-477, 484-494, 498-511, 518-541, 550-564, 576-585, 593-601, 631-637 | 1-235, 237-257, 259-401, 404-418, 430-650 | 2 | 1-15, 491-583 | 119 | 275 |
| NTHI1449 | HMW2B, OMP-85-like protein required for HMW1A and HMW2A secretion | 7-43, 47-59, 70-81, 87-94, 103-109, 112-121, 130-140, 160-170, 178-185, 206-217, 221-228, 230-263, 293-301, | 1-77, 95-138, 147-338, 345-437, 441-538 | 17 | 6-178, 318-353, 431-536 | 120 | 276 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 335-344, 346-354, 358-372, 386-399, 403-414, 416-430, 459-471, 490-499, 504-515 | | | | | |
| NTHI1450 | HMW2A, high molecular weight adhesin 2 | 12-29, 39-70, 73-80, 130-139, 143-151, 194-206, 210-216, 220-229, 231-244, 246-255, 287-294, 298-303, 310-317, 331-343, 365-370, 389-400, 417-436, 441-453, 503-523, 550-557, 569-575, 637-644, 661-668, 675-683, 697-703, 717-726, 750-756, 832-838, 859-867, 893-909, 937-944, 1003-1009, 1014-1020, 1042-1049, 1082-1088, 1099-1105, 1125-1133, 1196-1201, 1203-1209, 1244-1250, 1362-1369, 1375-1381, 1405-1419, 1437-1465, 1468-1474, 1482-1493, 1512-1518, 1520-1526, 1529-1536 | 1-24, 30-257, 269-347, 359-387, 391-405, 412-449, 483-587, 591-864, 871-1025, 1031-1112, 1119-1158, 1173-1212, 1282-1302, 1350-1462, 1479-1519 | 112 | 251-371, 426-456, 620-748, 761-783, 854-959, 965-1542 | 121 | 277 |
| NTHI1458 | recombination factor protein RarA | 25-36, 46-57, 66-73, 79-87, 106-115, 124-130, 132-139, 150-165, 170-179, 188-203, 209-220, 236-242, 255-268, 270-281, 286-300, 309-326, 332-351, 359-373, 412-417 | 7-55, 72-176, 185-239, 248-316, 330-363, 365-402, 409-444 | 16 | 3-30, 251-274, 278-299, 303-443 | 122 | 278 |
| NTHI1474 | UDP-GlcNAc--lipooligosaccharide N-acetylglucosamine glycosyltransferase | 4-17, 21-30, 34-41, 46-55, 61-66, 78-88, 103-110, 120-136, 146-153, 155-162, 175-181, 183-191, 195-215, 222-227, 242-248, 250-281, 289-306 | 1-133, 139-323 | 1 | 172-235 | 123 | 279 |
| NTHI1512 | hypothetical protein | 18-27, 33-61, 63-69, 81-87, 98-109, 112-123, | 1-119, 145-178, 200-234 | 3 | 160-194 | 124 | 280 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| ᵃHaemophilus influenzae antigenic protein | ᵃPutative function (by homology) | ᵇPredicted immunogenic aa | ᶜPredicted classII-restricted T cell epitope/ regions | ᵈNo. of selected clones per ORF | ᵉLocation of identified immunogenic region (aa) | ᶠSEQ ID NO (DNA) | ᶠSEQ ID NO (protein) |
|---|---|---|---|---|---|---|---|
| | | 161-168, 172-177, 191-203, 222-230 | | | | | |
| NTHI1542 | phage-related minor tail protein | 5-18, 20-29, 50-57, 68-83, 87-92, 96-108, 113-124, 129-142, 147-153, 176-186, 198-210, 212-224, 237-244, 270-289, 297-308, 314-327, 333-355, 365-378, 380-389, 391-401, 418-435, 437-446, 464-503, 507-568, 573-601, 606-644, 653-660, 702-720, 726-734, 737-749, 780-787 | 1-112, 115-170, 175-195, 253-355, 363-379, 384-457, 461-679, 681-723, 746-781 | 7 | 86-123, 283-358, 646-684, 705-796 | 125 | 281 |
| NTHI1552 | tail fiber protein | 4-11, 40-48, 60-69, 84-92, 113-130, 137-145, 147-164, 194-200, 230-237, 284-290, 329-335, 345-351, 389-409, 421-427, 447-453, 472-484, 486-494, 515-524, 538-544, 563-568, 581-590, 596-610, 653-662, 665-671, 689-703, 710-720, 746-760, 773-779 | 1-23, 39-74, 80-112, 120-180, 187-293, 303-317, 324-371, 389-438, 441-619, 635-677, 682-710, 721-782 | 9 | 146-239, 527-577 | 126 | 282 |
| NTHI1569 | hypothetical protein | 4-21, 34-40, 48-54, 61-72, 82-88, 135-155, 173-178 | 1-164, 170-184 | 4 | 73-113 | 127 | 283 |
| NTHI1593 | protease IV | 4-38, 49-60, 89-98, 105-113, 117-133, 137-146, 149-174, 186-207, 230-236, 247-260, 266-281, 307-315, 317-332, 349-354, 361-369, 391-400, 413-419, 427-433, 443-451, 462-472, 484-491, 495-512, 516-522, 531-538, 541-551, 556-564, 573-597, 603-612 | 1-81, 87-118, 141-176, 180-336, 359-460, 478-501, 505-522, 549-615 | 8 | 465-549, 552-599 | 128 | 284 |
| NTHI1638 | serine/threonine protein phosphatase family protein | 13-20, 28-34, 37-44, 49-57, 61-68, 77-83, 85-109, 118-140, 148-162, 169-175, 180-198, | 7-67, 73-105, 110-372, 383-405, 419-438, 441-502, 514-543, 552-571 | 5 | 96-153, 175-214, 246-338, 370-413 | 129 | 285 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 210-216, 236-270, 276-304, 330-337, 341-349, 364-371, 380-386, 388-406, 412-417, 422-437, 461-514, 518-525, 530-563 | | | | | |
| NTHI1667 | hypothetical protein | 7-26, 38-46, 60-68, 80-86, 99-105, 180-188 | 1-36, 59-97 | 27 | 11-146 | 130 | 286 |
| NTHI1702 | tryptophan synthase subunit beta | 15-37, 43-52, 59-69, 71-85, 89-100, 115-137, 154-174, 185-192, 194-204, 225-233, 250-259, 269-280, 296-318, 323-329, 335-341, 343-365, 370-378, 385-391 | 4-31, 44-83, 87-110, 128-216, 235-264, 271-312, 344-397 | 4 | 99-123, 259-275, 275, 306-358 | 131 | 287 |
| NTHI1707 | ABC transporter periplasmic protein | 6-16, 18-28, 31-50, 52-58, 89-98, 122-128, 133-141, 151-164, 172-183, 185-201, 222-232, 234-242, 244-275 | 1-37, 42-70, 74-158, 172-210, 217-275 | 1 | 183-275 | 132 | 288 |
| NTHI1746 | TrpH | 5-12, 14-47, 53-65, 75-81, 89-97, 113-126, 132-145, 162-168, 172-193, 201-209, 238-255, 260-271 | 18-38, 68-109, 130-155, 163-218, 222-269 | 4 | 81-139 | 133 | 289 |
| NTHI1760 | valyl-tRNA synthetase | 13-23, 39-53, 92-99, 156-176, 184-192, 202-212, 220-228, 236-243, 248-263, 265-272, 279-287, 301-310, 327-333, 347-363, 365-373, 377-382, 387-403, 408-421, 427-434, 465-473, 507-525, 529-534, 540-552, 566-572, 594-600, 621-628, 655-661, 672-678, 694-709, 716-729, 734-761, 765-776, 778-787, 803-812, 822-831, 840-850, 853-862, 864-883, 916-929, 946-951 | 1-22, 24-55, 57-85, 88-108, 110-149, 165-193, 197-271, 276-364, 377-409, 414-448, 454-575, 583-612, 614-665, 673-788, 800-870, 873-893, 900-930 | 10 | 9-62, 123-140, 336-400 | 134 | 290 |
| NTHI1774 | phosphate-binding periplasmic protein precursor PstS | 9-24, 32-46, 66-76, 84-111, 113-130, 137-158, 169-175, 203-210, 213-225, | 1-59, 84-261, 269-297, 312-332 | 4 | 15-96, 271-318 | 135 | 291 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI1784 | cell division protein MukB | 227-235, 237-243, 249-254, 262-267, 276-287, 296-304, 315-329 26-32, 66-73, 86-101, 123-133, 139-150, 156-162, 164-170, 186-192, 204-213, 221-229, 237-255, 258-266, 299-304, 308-313, 344-353, 367-384, 407-413, 432-448, 451-463, 466-483, 495-502, 516-528, 539-545, 547-557, 559-568, 570-579, 602-609, 611-617, 643-655, 675-681, 692-705, 722-734, 736-779, 786-806, 813-821, 839-872, 913-927, 939-946, 951-969, 991-1008, 1056-1087, 1104-1109, 1114-1126, 1146-1163, 1177-1183, 1192-1199, 1207-1213, 1224-1234, 1258-1264, 1271-1282, 1306-1319, 1323-1331, 1352-1359, 1374-1380, 1382-1392, 1415-1423, 1434-1447, 1455-1465, 1467-1474, 1485-1491, 1495-1504 | 7-70, 77-114, 116-176, 198-328, 346-398, 410-477, 493-561, 563-592, 600-655, 664-684, 689-709, 724-768, 772-832, 853-934, 945-1018, 1026-1115, 1128-1255, 1273-1367, 1384-1430, 1435-1510 | 11 | 33-87, 275-390, 524-542, 1025-1065 | 136 | 292 |
| NTHI1809 | glycogen branching enzyme | 36-42, 45-50, 59-87, 95-102, 110-116, 119-143, 147-156, 171-212, 217-227, 241-251, 269-278, 283-292, 300-309, 318-325, 329-341, 345-354, 388-394, 404-410, 463-469, | 19-57, 63-126, 134-263, 295-332, 342-363, 366-424, 432-461, 472-727 | 6 | 146-215, 270-425, 535-609 | 137 | 293 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 491-502, 510-538, 549-555, 599-611, 629-643, 652-666, 670-676, 695-702, 712-727 | | | | | |
| NTHI1812 | glutaminyl-tRNA synthetase | 33-39, 45-61, 63-73, 81-97, 108-133, 195-208, 213-228, 232-241, 249-256, 259-271, 280-290, 313-323, 328-343, 352-365, 368-375, 386-398, 410-418, 420-429, 441-448, 461-474, 481-490, 497-518, 531-537, 542-554 | 41-86, 106-130, 135-153, 179-228, 235-250, 265-353, 359-383, 388-439, 455-519, 526-557 | 4 | 79-137 | 138 | 294 |
| NTHI1816 | cytidine deaminase | 16-23, 31-77, 97-110, 120-133, 143-150, 156-163, 168-178, 181-209, 211-217, 219-226, 234-247, 257-264, 276-289 | 13-81, 94-158, 177-205, 208-292 | 5 | 67-87, 220-258 | 139 | 295 |
| NTHI1825 | deoxyguanosinetriphosphate triphosphohydrolase-like protein | 12-17, 45-62, 74-93, 111-121, 124-138, 163-171, 185-205, 213-221, 248-255, 262-268, 270-277, 280-301, 303-317, 325-332, 341-351, 362-370, 372-393, 440-446, 452-458 | 1-127, 140-454 | 3 | 22-55, 88-152, 289-345 | 140 | 296 |
| NTHI1838 | putative type I restriction enzyme HindVIIP M protein | 16-22, 29-42, 44-57, 77-83, 93-98, 111-117, 123-130, 141-150, 163-173, 180-187, 198-220, 232-255, 261-267, 279-284, 364-375, 380-385, 400-417, 424-430, 439-446, 454-459, 465-471, 484-491, 499-511, 528-535 | 23-69, 75-90, 103-140, 159-308, 322-473, 475-513, 519-538 | 9 | 209-271, 320-379, 400-442, 513-556 | 141 | 297 |
| NTHI1849 | hypothetical protein | 32-37, 49-56, 73-80, 95-101, 103-118, 129-139, 186-198, 208-214, 222-231, 244-251 | 1-20, 55-86, 92-118, 144-228, 231-249 | 12 | 167-245 | 142 | 298 |
| NTHI1857 | tail fiber protein | 4-11, 15-34, 48-66, 72-78, 98-109, 118-139, 141-149, 171-177, 182-188, 195-203, 205-222, 252-258, | 1-31, 39-105, 109-160, 168-238, 245-263, 273-351, 361-375, 382-429, 447-605, 613-627, 634-692, | 6 | 21-48, 60-105, 201-215, 545-633 | 143 | 299 |

TABLE 4-continued

Immunogenic proteins identified by bacterial surface display.
The 156 antigenic ORFs were identified by screening bacterial libraries displaying the fragmented
genome of NTHi 86-028NP with human immunoglobulin.

| <sup>a</sup>Haemophilus influenzae antigenic protein | <sup>a</sup>Putative function (by homology) | <sup>b</sup>Predicted immunogenic aa | <sup>c</sup>Predicted classII-restricted T cell epitope/regions | <sup>d</sup>No. of selected clones per ORF | <sup>e</sup>Location of identified immunogenic region (aa) | <sup>f</sup>SEQ ID NO (DNA) | <sup>f</sup>SEQ ID NO (protein) |
|---|---|---|---|---|---|---|---|
| | | 281-287, 292-298, 340-348, 388-394, 403-409, 447-467, 479-485, 505-511, 530-542, 544-552, 573-582, 589-594, 596-607, 621-626, 638-648, 654-668, 673-680, 682-690, 708-721, 723-729, 747-757, 769-778, 786-799, 802-818, 831-837 | 707-768, 782-806 | | | | |
| NTHI1885 | major capsid protein | 10-17, 44-54, 56-63, 69-81, 112-119, 125-134, 162-168, 171-177, 181-187, 206-221, 226-247, 256-263, 265-296, 299-305, 317-332, 335-346 | 1-45, 47-86, 109-127, 133-162, 168-190, 197-349 | 5 | 51-192, 261-281 | 144 | 300 |
| NTHI1905 | periplasmic serine protease do/HhoA-like precursor | 5-35, 37-57, 59-69, 100-106, 109-116, 124-130, 137-142, 147-154, 169-180, 190-197, 225-231, 237-244, 251-258, 261-271, 274-280, 287-310, 331-340, 360-366, 378-387, 407-415, 419-424, 441-452 | 1-87, 90-125, 136-154, 169-277, 279-337, 348-379, 390-463 | 7 | 271-450 | 145 | 301 |
| NTHI1915 | ABC transporter permease | 6-31, 41-47, 54-73, 76-151, 162-177, 187-201, 211-219, 224-251, 257-268, 272-278, 289-311 | 1-199, 207-320 | 3 | 69-97 | 146 | 302 |
| NTHI1925 | hypothetical protein | 4-11, 29-41, 46-83, 90-110, 118-130, 141-205 | 1-19, 21-218 | 1 | 93-163 | 147 | 303 |
| NTHI1929 | chaperone protein DnaK | 12-19, 37-42, 64-71, 101-107, 109-121, 135-146, 159-167, 173-181, 186-194, 215-220, 233-241, 258-264, 269-275, 277-287, 292-299, 304-325, 330-341, 345-355, 367-399, 420-427, | 1-30, 42-143, 158-181, 211-229, 237-264, 289-325, 330-355, 358-446, 450-553, 585-605 | 3 | 507-598 | 148 | 304 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 433-442, 470-476, 498-505, 529-535, 555-561, 565-572, 586-594, 596-606, 621-626 | | | | | |
| NTHI1945 | hypothetical protein | 4-16, 37-49, 53-62, 94-108, 112-122, 124-131, 136-145, 150-160, 168-179, 187-203, 205-231, 233-247, 256-269, 274-283, 291-299, 307-316, 321-331, 344-351, 361-384, 387-392 | 1-71, 74-192, 202-255, 268-300, 306-396 | 2 | 31-66, 117-140 | 149 | 305 |
| NTHI1955 | hypothetical protein | 4-13, 17-24, 34-43, 45-52, 62-70, 77-130, 136-145, 153-170, 177-193, 214-255, 257-269, 287-298, 317-328, 356-361, 376-391, 402-416, 420-432, 434-443, 447-457, 460-476 | 1-51, 53-93, 98-198, 210-288, 291-311, 318-393, 398-455 | 4 | 262-294, 428-474 | 150 | 306 |
| NTHI1957 | putative lipoprotein | 14-29, 64-76, 80-89, 98-108, 118-132, 138-146, 152-158, 178-184, 202-214, 216-226, 233-251, 254-266, 288-295, 301-311, 313-335, 337-346, 348-361, 379-385, 414-426, 433-443, 451-467, 485-492, 523-528, 533-551, 566-572 | 1-88, 115-196, 198-575 | 10 | 37-179, 309-487 | 151 | 307 |
| NTHI1964 | alpha-ketoglutarate decarboxylase | 4-9, 39-54, 70-80, 92-99, 101-113, 121-145, 159-165, 170-176, 179-192, 209-215, 220-226, 233-239, 253-260, 284-292, 313-318, 321-354, 364-387, 395-408, 423-429, 431-441, 446-451, 467-475, 491-498, 501-513, 535-540, 552-557, 570-595, 619-632, 642-650, 656-665, 673-688, 710-721, 729-739, | 1-39, 71-95, 99-146, 150-300, 311-366, 378-424, 426-625, 635-688, 707-746, 749-823, 829-856, 869-886, 895-946 | 8 | 8-35, 181-217, 236-329, 491-566 | 152 | 308 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| | | 752-761, 764-779, 790-812, 818-823, 832-849, 857-893, 898-905, 908-923, 925-938, 940-947 | | | | | |
| NTHI1983 | HMW1A, high molecular weight adhesin 1 | 12-29, 39-70, 73-80, 113-118, 133-139, 143-149, 194-205, 210-216, 223-229, 231-244, 286-294, 297-303, 310-317, 331-343, 365-370, 389-400, 417-427, 431-439, 481-493, 495-501, 508-515, 539-547, 560-566, 578-589, 625-632, 644-652, 668-681, 708-725, 739-749, 757-769, 784-796, 799-805, 853-859, 878-884, 887-893, 922-929, 1002-1008, 1054-1059, 1069-1077, 1115-1125, 1176-1181, 1186-1191, 1195-1201, 1235-1243, 1264-1269, 1283-1289, 1312-1318, 1325-1331, 1344-1349, 1355-1367, 1387-1393, 1395-1415, 1418-1424, 1432-1443, 1462-1468, 1470-1476, 1479-1486 | 1-24, 30-257, 269-347, 359-387, 391-405, 412-453, 461-534, 536-568, 575-670, 674-853 855-929, 931-1013, 1025-1086, 1111-1148, 1183-1203, 1208-1226, 1232-1248, 1265-1284, 1293-1334, 1340-1412, 1429-1469 | 45 | 15-82, 302-383, 542-619, 827-905, 945-1036, 1045-1297, 1304-1450 | 153 | 309 |
| NTHI1994 | electron transport complex protein RnfG | 9-33, 36-55, 63-69, 73-82, 89-95, 104-112, 114-126, 177-184, 187-193, 196-204 | 1-43, 50-160, 170-207 | 9 | 128-185 | 154 | 310 |

TABLE 4-continued

Immunogenic proteins identified by bacterial surface display.
The 156 antigenic ORFs were identified by screening bacterial libraries displaying the fragmented genome of NTHi 86-028NP with human immunoglobulin.

| [a]Haemophilus influenzae antigenic protein | [a]Putative function (by homology) | [b]Predicted immunogenic aa | [c]Predicted classII-restricted T cell epitope/ regions | [d]No. of selected clones per ORF | [e]Location of identified immunogenic region (aa) | [f]SEQ ID NO (DNA) | [f]SEQ ID NO (protein) |
|---|---|---|---|---|---|---|---|
| NTHI2041 | exoribonuclease II | 5-16, 22-29, 33-48, 74-80, 83-90, 96-104, 115-121, 125-135, 142-155, 160-168, 171-178, 193-201, 211-217, 226-244, 250-258, 263-269, 272-279, 284-292, 300-325, 339-348, 358-364, 368-376, 391-397, 400-412, 430-439, 476-490, 493-505, 522-534, 540-546, 562-576, 580-586, 591-598, 602-608, 623-628, 635-646, 651-656 | 1-15, 30-66, 72-113, 121-332, 338-412, 429-543, 550-579, 581-659 | 10 | 107-118, 126-187, 266-361, 364-427 | 155 | 311 |
| NTHI2048 | HTH-type transcriptional regulator MetR | 5-18, 22-47, 49-54, 69-75, 77-83, 87-93, 97-111, 121-133, 135-145, 147-154, 159-178, 197-204, 209-215, 229-238, 242-262, 269-276, 282-296, 298-306 | 2-45, 48-83, 112-152, 154-185, 190-309 | 3 | 33-107, 172-202, 235-305 | 156 | 312 |

[a]From GenBank record NC_007146.
[b]Prediction of sequences longer than 5 amino acids capable of inducing an antibody response was performed with the program ANTIGENIC (Kolaskar, A. S. and Tongaonkar, P. C., 1990).
[c]Prediction of sequences capable of inducing a human class II-restricted T cell response was performed with the program "MHC-II binding predictions" from IEDB Analysis (www.immuneepitope.org/). The prediction was performed for the eleven human MHC II types HLADRB1*0101, *0301, *0401, *0404, *0405, *0701, *0802, *1101, *1302, *1501 and HLADRB5*0101 with a consensus approach of three methods (ARB, SMM_align, Sturniolo). Epitopes with a consensus percentile up to 5 in any of the MHC II types were mapped (Zhang et al., 2008; Wang et al., 2008). In NTHI0007 the selenocysteine residue (U) at position 204 was replaced by cysteine (C) for the antigenic and MHC II epitope predictions.
[d]Number of clones selected by human immunoglobulin from bacterial display libraries matching the ORF.
[e]Location of immunogenic region, based on sequence alignment with the clones selected by human immunoglobulin from bacterial display libraries matching the ORF.
[f]Sequence identification numbers for nucleotide (SEQ ID NOs 1-156) and protein sequences (SEQ ID NOs 157-312).

TABLE 5

List of 47 NTHi isolates used for gene distribution (PCR genotyping) analysis.

| Internal Intercell reference number A | Internal Intercell reference number B | Supplier strain number | Species | Geographical origin |
|---|---|---|---|---|
| 86-028NP | 86-028NP | 86-028NP | H. influenzae | Harrison et al., 2005 |
| 5 | I, A5 | 1090062 | H. influenzae | Australia |
| 8 | I, A8 | 1090068 | H. influenzae | Australia |
| 63 | I, G9 | 6681076 | H. influenzae | South Africa |
| 66 | I, H3 | 6682077 | H. influenzae | South Africa |
| 22 | I, C4 | 4140081 | H. influenzae | China |
| 41 | I, E5 | 1120061 | H. influenzae | Indonesia |
| 46 | I, F1 | 1080086 | H. influenzae | Japan |
| 48 | I, F3 | 1081084 | H. influenzae | Japan |
| 67 | I, H4 | 1070090 | H. influenzae | South Korea |
| 70 | I, H7 | 1071062 | H. influenzae | South Korea |
| 79 | I, I7 | 3696091 | H. influenzae | Taiwan |
| 83 | II, A2 | 2660082 | H. influenzae | Turkey |
| 9 | I, A9 | 1130067 | H. influenzae | Austria |
| 11 | I, B2 | 3131080 | H. influenzae | Austria |
| 17 | I, B8 | 6400102 | H. influenzae | Bulgaria |
| 27 | I, C9 | 6620087 | H. influenzae | Czech Republic |
| 33 | I, D6 | 1501076 | H. influenzae | France |
| 36 | I, D9 | 6504071 | H. influenzae | France |
| 37 | I, E1 | 1521062 | H. influenzae | Germany |
| 40 | I, E4 | 1522072 | H. influenzae | Germany |
| 42 | I, E6 | 1530062 | H. influenzae | Italy |
| 44 | I, E8 | 1530079 | H. influenzae | Italy |
| 45 | I, E9 | 1530086 | H. influenzae | Italy |
| 55 | I, G1 | 4641078 | H. influenzae | Poland |

TABLE 5-continued

List of 47 NTHi isolates used for gene distribution (PCR genotyping) analysis.

| Internal Intercell reference number A | Internal Intercell reference number B | Supplier strain number | Species | Geographical origin |
|---|---|---|---|---|
| 58 | I, G4 | 4641092 | H. influenzae | Poland |
| 59 | I, G5 | 6671072 | H. influenzae | Russia |
| 61 | I, G7 | 6671084 | H. influenzae | Russia |
| 71 | I, H8 | 1551100 | H. influenzae | Spain |
| 72 | I, H9 | 6549074 | H. influenzae | Spain |
| 75 | I, I3 | 1610090 | H. influenzae | Switzerland |
| 87 | II, A6 | 1541075 | H. influenzae | United Kingdom |
| 89 | II, A8 | 2541085 | H. influenzae | United Kingdom |
| 1 | I, A1 | 4051099 | H. influenzae | Argentina |
| 3 | I, A3 | 4053085 | H. influenzae | Argentina |
| 13 | I, B4 | 1041099 | H. influenzae | Brazil |
| 15 | I, B6 | 6040079 | H. influenzae | Brazil |
| 23 | I, C5 | 4690100 | H. influenzae | Colombia |
| 31 | I, D4 | 3691101 | H. influenzae | Ecuador |
| 54 | I, F9 | 3693080 | H. influenzae | Peru |
| 95 | II, B5 | 5692120 | H. influenzae | Venezuela |
| 18 | I, B9 | 1020080 | H. influenzae | Canada |
| 20 | I, C2 | 1020089 | H. influenzae | Canada |
| 50 | I, F5 | 1031068 | H. influenzae | Mexico |
| 52 | I, F7 | 1031107 | H. influenzae | Mexico |
| 91 | II, B1 | 1001074 | H. influenzae | United States |
| 93 | II, B3 | 1001081 | H. influenzae | United States |

The NTHi strain 86-028NP also used to construct the libraries was isolated from the nasopharynx of a child with chronic otitis media and completely sequenced (Harrison et al., 2005). Other strains were obtained from GR Micro.

TABLE 6

Conservation of 156 open reading frames coding for antigenic proteins in 47 NTHi isolates

| $^a$SEQ ID NO (DNA) | NTHi ORF | Common name | Positive of 47 tested |
|---|---|---|---|
| 1 | NTHI0007 | formate dehydrogenase major subunit | 47 |
| 2 | NTHI0039 | penicillin-binding protein 2 | 47 |
| 3 | NTHI0079 | N-acetylmuramoyl-L-alanine amidase AmiB precursor | 33 |
| 4 | NTHI0083 | DNA repair protein RecN | 46 |
| 5 | NTHI0088 | anaerobic ribonucleoside triphosphate reductase | 47 |
| 6 | NTHI0126 | hypothetical protein | 35 |
| 7 | NTHI0127 | hypothetical protein | 33 |
| 8 | NTHI0128 | hypothetical protein | 6 |
| 9 | NTHI0130 | hypothetical protein | 17 |
| 10 | NTHI0131 | hypothetical protein | 10 |
| 11 | NTHI0132 | hypothetical protein | 7 |
| 12 | NTHI0134 | hypothetical protein | 24 |
| 13 | NTHI0145 | hypothetical protein | 8 |
| 14 | NTHI0166 | homoserine kinase | 47 |
| 15 | NTHI0193 | putative type I site-specific restriction-modification system, R subunit | 43 |
| 16 | NTHI0202 | hemin receptor | 45 |
| 17 | NTHI0203 | 23S rRNA m(2)G2445 methyltransferase | 47 |
| 18 | NTHI0206 | hypothetical protein | 43 |
| 19 | NTHI0208 | high-affinity zinc transporter periplasmic component | 45 |
| 20 | NTHI0210 | UDP-N-acetylmuramate: L-alanyl-gamma-D-glutamyl-meso-diaminopimelate ligase | 45 |
| 21 | NTHI0225 | Outer membrane protein P2 precursor | 32 |
| 22 | NTHI0228 | N-acetylneuraminate lyase | 30 |
| 23 | NTHI0239 | HflK | 47 |
| 24 | NTHI0269 | formate acetyltransferase | 47 |
| 25 | NTHI0291 | potassium efflux protein KefA | 47 |
| 26 | NTHI0306 | 3-dehydroquinate synthase | 47 |
| 27 | NTHI0321 | aerobic respiration control sensor protein ArcB | 47 |
| 28 | NTHI0334 | polynucleotide phosphorylase/polyadenylase | 46 |
| 29 | NTHI0338 | putative soluble lytic transglycosylase fused to an ABC-type amino acid-binding protein | 47 |
| 30 | NTHI0351 | S-adenosylmethionine: tRNA ribosyltransferase-isomerase | 44 |
| 31 | NTHI0354 | adhesion and penetration protein Hap | 42 |
| 32 | NTHI0358 | TonB | 47 |
| 33 | NTHI0363 | lipoprotein | 47 |
| 34 | NTHI0369 | heme-hemopexin utilization protein C | 47 |
| 35 | NTHI0370 | heme/hemopexin-binding protein B | 47 |
| 36 | NTHI0371 | heme/hemopexin-binding protein A | 47 |
| 37 | NTHI0374 | nitrate/nitrite sensor protein NarQ | 46 |
| 38 | NTHI0375 | UDP-N-acetylenolpyruvoylglucosamine reductase | 47 |
| 39 | NTHI0382 | glutamyl-tRNA synthetase | 45 |
| 40 | NTHI0407 | putative type IV pilin secretion protein | 47 |
| 41 | NTHI0408 | putative type IV pilin secretion protein | 46 |
| 42 | NTHI0448 | opacity associated protein | 44 |
| 43 | NTHI0458 | primosome assembly protein PriA | 43 |
| 44 | NTHI0463 | nitrate reductase | 47 |
| 45 | NTHI0472 | CMP-Neu5Ac--lipooligosaccharide alpha 2-3 sialyltransferase | 47 |
| 46 | NTHI0503 | cell envelope integrity inner membrane protein TolA | 47 |

TABLE 6-continued

Conservation of 156 open reading frames coding for antigenic proteins in 47 NTHi isolates

| ªSEQ ID NO (DNA) | NTHi ORF | Common name | Positive of 47 tested |
|---|---|---|---|
| 47 | NTHI0510 | long-chain-fatty-acid--CoA ligase | 47 |
| 48 | NTHI0522 | long-chain fatty acid ABC transporter | 47 |
| 49 | NTHI0525 | putative cell cycle protein MesJ | 47 |
| 50 | NTHI0529 | high-affinity zinc uptake system membrane protein ZnuB | 47 |
| 51 | NTHI0532 | metalloprotease | 47 |
| 52 | NTHI0567 | penicillin-binding protein 1A | 47 |
| 53 | NTHI0573 | PTS system, fructose-specific IIBC component | 47 |
| 54 | NTHI0574 | 1-phosphofructokinase | 47 |
| 55 | NTHI0585 | autotransported protein Lav | 45 |
| 56 | NTHI0588 | survival protein SurA-like protein | 47 |
| 57 | NTHI0625 | ATP-dependent protease ATP-binding subunit | 47 |
| 58 | NTHI0630 | D-ribose transporter ATP binding protein | 29 |
| 59 | NTHI0645 | nucleoside permease | 46 |
| 60 | NTHI0652 | ribonuclease I | 47 |
| 61 | NTHI0668 | co-chaperonin GroES | 43 |
| 62 | NTHI0670 | 50S ribosomal protein L9 | 47 |
| 63 | NTHI0716 | periplasmic negative regulator of sigmaE | 46 |
| 64 | NTHI0739 | C4-dicarboxylate transporter | 45 |
| 65 | NTHI0741 | bifunctional 2',3'-cyclic nucleotide 2'-phosphodiesterase/3'-nucleotidase periplasmic precursor protein | 43 |
| 66 | NTHI0745 | 30S ribosomal protein S12 | 47 |
| 67 | NTHI0762 | bifunctional N-acetylglucosamine-1-phosphate uridyltransferase/glucosamine-1-phosphate acetyltransferase | 47 |
| 68 | NTHI0779 | ABC transporter ATP-binding protein | 47 |
| 69 | NTHI0782 | hemoglobin-haptoglobin binding protein B | 47 |
| 70 | NTHI0816 | Outer membrane protein P4, NADP phosphatase | 47 |
| 71 | NTHI0830 | lipoprotein | 41 |
| 72 | NTHI0834 | DNA mismatch repair protein | 46 |
| 73 | NTHI0870 | L-fuculokinase | 46 |
| 74 | NTHI0921 | murein transglycosylase C | 47 |
| 75 | NTHI0945 | 30S ribosomal protein S3 | 45 |
| 76 | NTHI0960 | 50S ribosomal protein L15 | 47 |
| 77 | NTHI1012 | thiol: disulfide interchange protein DsbA | 47 |
| 78 | NTHI1024 | DNA polymerase I | 47 |
| 79 | NTHI1028 | ClpB | 47 |
| 80 | NTHI1030 | ribonuclease R | 47 |
| 81 | NTHI1034 | CMP-neu5Ac--lipooligosaccharide alpha 2-3 sialyltransferase | 31 |
| 82 | NTHI1048 | thiol:disulfide interchange protein precursor | 47 |
| 83 | NTHI1059 | putative membrane-fusion protein | 47 |
| 84 | NTHI1063 | multidrug resistance protein A | 46 |
| 85 | NTHI1083 | Outer membrane protein 26 | 47 |
| 86 | NTHI1084 | protective surface antigen D15 | 47 |
| 87 | NTHI1085 | zinc metalloprotease | 45 |
| 88 | NTHI1093 | glycyl-tRNA synthetase subunit beta | 47 |
| 89 | NTHI1094 | hypothetical protein | 9 |
| 90 | NTHI1114 | transcriptional regulator NrdR | 47 |
| 91 | NTHI1127 | deoxyuridine 5'-triphosphate nucleotidohydrolase | 46 |
| 92 | NTHI1145 | acetyl-CoA carboxylase biotin carboxylase subunit | 46 |
| 93 | NTHI1160 | 2-isopropylmalate synthase | 47 |
| 94 | NTHI1164 | IgA-specific serine endopeptidase | 41 |
| 95 | NTHI1168 | transferrin-binding protein 1 | 47 |
| 96 | NTHI1169 | transferrin-binding protein 2 precursor | 42 |
| 97 | NTHI1175 | putative inner membrane protein translocase component YidC | 47 |
| 98 | NTHI1188 | biotin synthase | 47 |
| 99 | NTHI1199 | ATPase | 38 |
| 100 | NTHI1207 | anaerobic dimethyl sulfoxide reductase chain A precursor | 47 |
| 101 | NTHI1231 | ATP-dependent RNA helicase HrpA | 47 |
| 102 | NTHI1238 | CTP synthetase | 47 |
| 103 | NTHI1244 | UDP-N-acetylglucosamine 1-carboxyvinyltransferase | 44 |
| 104 | NTHI1253 | cytochrome c biogenesis protein CcmA | 46 |
| 105 | NTHI1265 | NAD-dependent DNA ligase LigA | 47 |
| 106 | NTHI1266 | cell division protein ZipA | 46 |
| 107 | NTHI1286 | oligopeptide transport ATP-binding protein | 46 |
| 108 | NTHI1292 | periplasmic oligopeptide-binding protein | 47 |
| 109 | NTHI1299 | peptidoglycan synthetase FtsI | 47 |
| 110 | NTHI1300 | UDP-N-acetylmuramoylalanyl-D-glutamate--2,6-diaminopimelate ligase | 45 |
| 111 | NTHI1308 | D-alanine--D-alanine ligase | 47 |
| 112 | NTHI1323 | Na+/dicarboxylate symporter | 43 |
| 113 | NTHI1326 | cysteine/glutathione ABC transporter membrane/ATP-binding component | 47 |
| 114 | NTHI1332 | Outer membrane protein P5 | 45 |
| 115 | NTHI1342 | opacity protein | 46 |
| 116 | NTHI1390 | heme utilization protein | 47 |
| 117 | NTHI1403 | phosphoenolpyruvate carboxylase | 44 |

TABLE 6-continued

Conservation of 156 open reading frames coding for antigenic proteins in 47 NTHi isolates

| ªSEQ ID NO (DNA) | NTHi ORF | Common name | Positive of 47 tested |
|---|---|---|---|
| 118 | NTHI1423 | aromatic amino acid aminotransferase | 47 |
| 119 | NTHI1448 | HMW2C, putative glycosyltransferase involved in glycosylation of HMW1A and HMW2A | 33 |
| 120 | NTHI1449 | HMW2B, OMP-85-like protein required for HMW1A and HMW2A secretion | 38 |
| 121 | NTHI1450 | HMW2A, high molecular weight adhesin 2 | 12 |
| 122 | NTHI1458 | recombination factor protein RarA | 47 |
| 123 | NTHI1474 | UDP-GlcNAc--lipooligosaccharide N-acetylglucosamine glycosyltransferase | 46 |
| 124 | NTHI1512 | hypothetical protein | 16 |
| 125 | NTHI1542 | phage-related minor tail protein | 31 |
| 126 | NTHI1552 | tail fiber protein | 27 |
| 127 | NTHI1569 | hypothetical protein | 27 |
| 128 | NTHI1593 | protease IV | 28 |
| 129 | NTHI1638 | serine/threonine protein phosphatase family protein | 44 |
| 130 | NTHI1667 | hypothetical protein | 47 |
| 131 | NTHI1702 | tryptophan synthase subunit beta | 47 |
| 132 | NTHI1707 | ABC transporter periplasmic protein | 45 |
| 133 | NTHI1746 | TrpH | 45 |
| 134 | NTHI1760 | valyl-tRNA synthetase | 47 |
| 135 | NTHI1774 | phosphate-binding periplasmic protein precursor PstS | 46 |
| 136 | NTHI1784 | cell division protein MukB | 47 |
| 137 | NTHI1809 | glycogen branching enzyme | 46 |
| 138 | NTHI1812 | glutaminyl-tRNA synthetase | 47 |
| 139 | NTHI1816 | cytidine deaminase | 47 |
| 140 | NTHI1825 | deoxyguanosinetriphosphate triphosphohydrolase-like protein | 43 |
| 141 | NTHI1838 | putative type I restriction enzyme HindVIIP M protein | 47 |
| 142 | NTHI1849 | hypothetical protein | 43 |
| 143 | NTHI1857 | tail fiber protein | 21 |
| 144 | NTHI1885 | major capsid protein | 25 |
| 145 | NTHI1905 | periplasmic serine protease do/HhoA-like precursor | 47 |
| 146 | NTHI1915 | ABC transporter permease | 47 |
| 147 | NTHI1925 | hypothetical protein | 47 |
| 148 | NTHI1929 | chaperone protein DnaK | 47 |
| 149 | NTHI1945 | hypothetical protein | 46 |
| 150 | NTHI1955 | hypothetical protein | 47 |
| 151 | NTHI1957 | putative lipoprotein | 47 |
| 152 | NTHI1964 | alpha-ketoglutarate decarboxylase | 47 |
| 153 | NTHI1983 | HMW1A, high molecular weight adhesin 1 | 8 |
| 154 | NTHI1994 | electron transport complex protein RnfG | 47 |
| 155 | NTHI2041 | exoribonuclease II | 46 |
| 156 | NTHI2048 | HTH-type transcriptional regulator MetR | 29 |

A total number of 47 NTHi isolates, including the 86-028NP isolate also used for library construction as a positive PCR control, were tested by PCR with oligonucleotides specific for the genes encoding relevant antigens.
The table lists the number of positive PCR results for the 47 NTHi isolates tested.
ªSequence identification numbers (SEQ ID NOs).

TABLE 7

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 313 | GCGTGATCCGTTACCTATT | NTHI0007_fwd | 1197 |
| 314 | GTTGAGCATAATTCCAAGTCA | NTHI0007_rev | |
| 315 | GAAAAAACTGAAAATTTAGACCG | NTHI0039_fwd | 699 |
| 316 | CGCACCTTGTGTCGCAC | NTHI0039_rev | |
| 317 | GATTATTTTAATACTGATAGCATTTGC | NTHI0079_fwd | 1606 |
| 318 | GATTTTATTTGCACCTGCATC | NTHI0079_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR product size |
|---|---|---|---|
| 319 | CGAACAGCTAACCCAACTTTC | NTHI0083_fwd | 898 |
| 320 | GGTCATTTTGTTTCAGTTTTATTATC | NTHI0083_rev | |
| 321 | GCGAAAAAAGCATTAATGACG | NTHI0088_fwd | 587 |
| 322 | GGTACGCGATCGTAGCTATAATC | NTHI0088_rev | |
| 323 | CTGATGAATTACTTAATTACTTTTTACC | NTHI0126_fwd | 1057 |
| 324 | GATTCCAAGCAAAGAGTGCC | NTHI0126_rev | |
| 325 | GTGCGGGCAGAGAGTCTAG | NTHI0127_fwd | 943 |
| 326 | CATGAGATGTCCTTATGGTTTG | NTHI0127_rev | |
| 327 | GACAGTTTTTATACTGTAAGTGGTTTAG | NTHI0128_fwd | 857 |
| 328 | GCAAAACAACATGGCGAG | NTHI0128_rev | |
| 329 | CTTAGGCTTTGATTTTTGGTTG | NTHI0130_fwd | 1052 |
| 330 | GCTATCTAATTCAGGTGGATAACC | NTHI0130_rev | |
| 331 | GTGTAGATGAGTATTTCAAAGATGAAC | NTHI0131_fwd | 1216 |
| 332 | GATAAATCTTTAAAAGAGATATCTAAAGTATC | NTHI0131_rev | |
| 333 | CTGATGGCTGGATTTCTTTTC | NTHI0132_fwd | 962 |
| 334 | CCATGTGGATCAGATAACCAG | NTHI0132_rev | |
| 335 | CCAGGTGGGCTTTTTGTTG | NTHI0134_fwd | 844 |
| 336 | GATTAAAATTCATCGGTAGCCAG | NTHI0134_rev | |
| 337 | GTTTAGCCAGTGAAATTGCTG | NTHI0145_fwd | 1186 |
| 338 | GAGCTAGTAATAAATCCTGAACCAG | NTHI0145_rev | |
| 339 | GCGGTAGATCTGAATAATCCAC | NTHI0166_fwd | 1323 |
| 340 | CTCAACAAGAGGCAATTCAAG | NTHI0166_rev | |
| 341 | CTATGAAGCAGGCGATTGAAG | NTHI0193_fwd | 1056 |
| 342 | CATCTAAAATTTCATCAAATTCATCC | NTHI0193_rev | |
| 343 | CATTAAATATTAATGGAATGGGTG | NTHI0202_fwd | 1454 |
| 344 | GGTATCTGCAGCATTGCCTAC | NTHI0202_rev | |
| 345 | GTAGCTCGTCGGGCTCATAAC | NTHI0203_fwd | 1116 |
| 346 | GGTGGATTACAGATAACCGTACC | NTHI0203_rev | |
| 347 | CAATGGCTTCAGTGGCATC | NTHI0206_fwd | 1167 |
| 348 | GTAATTCTCAAAGGGAAAAAGAG | NTHI0206_rev | |
| 349 | CCTCTTGAAAATGCACATTGAC | NTHI0208_fwd | 1169 |
| 350 | GCTAAACATTCCATGTAGCTATCTG | NTHI0208_rev | |
| 351 | GTTCAGTGGCGTTAATTATAGATC | NTHI0210_fwd | 1617 |
| 352 | CCATCGGTGATTTAATATGTGG | NTHI0210_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 353 | CATTTAAAAAGTGTGATCTTGATG | NTHI0225_fwd | 1467 |
| 354 | CTTAAATAGCTAATTGATTTAAAAATCTG | NTHI0225_rev | |
| 355 | GCATAGTTTGCGTTCCCC | NTHI0228_fwd | 1262 |
| 356 | GCACCTTCCCCCGTAAAC | NTHI0228_rev | |
| 357 | CGCACTTTTATGAATGGAAT | NTHI0239_fwd | 1644 |
| 358 | CAGAGCCATCTAAAGTACGAAT | NTHI0239_rev | |
| 359 | GGTATTGATGAAAAATTAGGTATGC | NTHI0269_fwd | 1172 |
| 360 | GCATAAATAAAATAAAACGAATACC | NTHI0269_rev | |
| 361 | CTTTAGCAAAAGTGCGGTTG | NTHI0291_fwd | 1117 |
| 362 | CCGCATTCTTAACTCATCTTG | NTHI0291_rev | |
| 363 | GTATTGGAAGATTTAGCAAAAATTC | NTHI0306_fwd | 1452 |
| 364 | CCAAAATATAGCGTTCAAAATTAG | NTHI0306_rev | |
| 365 | CACTGTTAAAAATTATCGTCAATTC | NTHI0321_fwd | 1192 |
| 366 | CAATACCGCTACCCGCAC | NTHI0321_rev | |
| 367 | CTTCCCATTAACCGTAAACTACC | NTHI0334_fwd | 929 |
| 368 | CAATGATTTGTGCATCACGTTC | NTHI0334_rev | |
| 369 | GATAATCAAGAGCAGTTATTTGATG | NTHI0338_fwd | 1068 |
| 370 | GCGAATATTTTCTACATATTGATAGG | NTHI0338_rev | |
| 371 | GGAATGTAGATAGTGGCTTAACG | NTHI0351_fwd | 1036 |
| 372 | GTTAATCATACTAAGGATAAAAATATGAC | NTHI0351_rev | |
| 373 | CTTTAACAAATCACAGCCAAT | NTHI0354_fwd | 600 |
| 374 | CTAACGTGAATGTGAGTTTGTC | NTHI0354_rev | |
| 375 | CTTTAAAAATTGATGCCGAAG | NTHI0358_fwd | 150 |
| 376 | CATAGATTGAAAAGTAAATGATAAAAATC | NTHI0358_rev | |
| 377 | CAATTCCAGTGAAGTGGGC | NTHI0363_fwd | 1045 |
| 378 | GCGTGATTTAAATTCTAGTTAATAAC | NTHI0363_rev | |
| 379 | CAATTAAATGCAAATGATTATAAATAAAC | NTHI0369_fwd | 1132 |
| 380 | CACTGACTTTACGCTGTTCTTTC | NTHI0369_rev | |
| 381 | GCAAGTACAGATTTTAGATCGAAAC | NTHI0370_fwd | 1049 |
| 382 | GTAAAATTTGCTCGTGAGACAAG | NTHI0370_rev | |
| 383 | CTTTAAAACTGATGGCGATAC | NTHI0371_fwd | 785 |
| 384 | TTAAACTGAGTAAACCAAAAGC | NTHI0371_rev | |
| 385 | GTCAGAAAGAACAGATTTTATTAATG | NTHI0374_fwd | 864 |
| 386 | GCGTAATCCCCATTAAACG | NTHI0374_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 387 | GTTGGCATTCCAAACCTTG | NTHI0375_fwd | 1393 |
| 388 | GGATATTCATTTGCTGCACG | NTHI0375_rev | |
| 389 | CAATATCGTGATGATGGTTACTTAC | NTHI0382_fwd | 837 |
| 390 | CTTGCTTTATTAATTTGGTGGAG | NTHI0382_rev | |
| 391 | GGTGGAAATTTAATAAATTCTTGTG | NTHI0407_fwd | 1016 |
| 392 | CTGCAACATAATTTGTAAACTTTGAC | NTHI0407_rev | |
| 393 | CGAGCGCAACAAAATAAAC | NTHI0408_fwd | 1024 |
| 394 | GATTGAAGCAGTCGTTCAAGC | NTHI0408_rev | |
| 395 | CCAAGTTCTGACACCGTTGAG | NTHI0448_fwd | 986 |
| 396 | CTTTTTCTACTTGCATTTTTGC | NTHI0448_rev | |
| 397 | GTGTTCCCCAGTTATCATTCAT | NTHI0458_fwd | 1067 |
| 398 | CATCAATTTCTACATTAAAACGTG | NTHI0458_rev | |
| 399 | CTGGGAAAATGCACGATTC | NTHI0463_fwd | 960 |
| 400 | GACCAAATTCAGCGTATTCTTC | NTHI0463_rev | |
| 401 | CAGGTAATGGAACAAGTTTAAAATC | NTHI0472_fwd | 831 (825) |
| 402 | CATTAGGTAAACGTAATATATCCCAG | NTHI0472_rev | |
| 403 | CAATTATCTAGACAGGAATTTGATAAG | NTHI0503_fwd | 1453 |
| 404 | CGTTTTAATAATTTCATTTTGTTACC | NTHI0503_rev | |
| 405 | CCAACAAATTAGGATAAAAAATGG | NTHI0510_fwd | 940 |
| 406 | CCAGTGATTGCTTCAAAACG | NTHI0510_rev | |
| 407 | CGGTCATTTTCTTTTCCTTATAT | NTHI0522_fwd | 1756 |
| 408 | TGCTCTTTTTCAAAATCAATATG | NTHI0522_rev | |
| 409 | CGAGCGAGTACAAGTAGATAAAAC | NTHI0525_fwd | 1128 |
| 410 | CTTGCCTTTAGGTTTTTATCTAAG | NTHI0525_rev | |
| 411 | CAACATATTTGTTGTGCAGGTAC | NTHI0529_fwd | 1170 |
| 412 | GATTTCATCAGTTAAATCAACTTTATC | NTHI0529_rev | |
| 413 | CGAGATTCAAAATTCTTTAAATAGTAG | NTHI0532_fwd | 626 |
| 414 | CATAATGTAAATGCGGCCC | NTHI0532_rev | |
| 415 | GGTTTACCTAAAGCACCTTCAAC | NTHI0567_fwd | 1037 |
| 416 | GCTTCGCTAGCAAAATATTGATC | NTHI0567_rev | |
| 417 | CAAATAACGATGATTGAAGGATAG | NTHI0573_fwd | 965 |
| 418 | CCGCTTCACTTGCCAGC | NTHI0573_rev | |
| 419 | GAAGTGAAGAATATAATGCTTCC | NTHI0574_fwd | 1343 |
| 420 | GCCGATAATAAAGACTTTTTACC | NTHI0574_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 421 | GAAAAGGGATTTATACGCTCTC | NTHI0585_fwd | 905 |
| 422 | GATTTTCACTGCTATACCAAATTG | NTHI0585_rev | |
| 423 | GATTTTTGTTGATCGTGGCC | NTHI0588_fwd | 1246 |
| 424 | CGCAATTAAAAATTTCTTCATAAG | NTHI0588_rev | |
| 425 | CATATTATTGGTCAAGCCGATG | NTHI0625_fwd | 1029 |
| 426 | GGCTTTATATTGTTCGGTTAAAG | NTHI0625_rev | |
| 427 | GAAAATCGTGGCATTGTTTATATC | NTHI0630_fwd | 1074 |
| 428 | GCGTAAAATATTCAAATATTATCTACG | NTHI0630_rev | |
| 429 | CATTACAAAAGCATTGGGTAC | NTHI0645_fwd | 1073 |
| 430 | CAACAACATCTTGTAAAAAGTTTC | NTHI0645_rev | |
| 431 | GATTGGGCAAACTTTTTGG | NTHI0652_fwd | 1221 |
| 432 | CCATCTTTTACTGGCACATTAAG | NTHI0652_rev | |
| 433 | CTGATTGGATTATGCACGGT | NTHI0668_fwd | 973 |
| 434 | CGAATTTATCTTCTAATTCGATTTC | NTHI0668_rev | |
| 435 | CGCTACATTAAAGAACTATATTTCAG | NTHI0670_fwd | 801 |
| 436 | GAATGATGTAATTCGCTTATACG | NTHI0670_rev | |
| 437 | GCTTGAGAAAAAAGTCGTCG | NTHI0716_fwd | 1283 |
| 438 | CGTGAGCGAGCAAATCTAATT | NTHI0716_rev | |
| 439 | GTTCTTCTCACTCAGCAATGATTAG | NTHI0739_fwd | 1056 |
| 440 | GGATTTATAATTTGTTTGCCAAG | NTHI0739_rev | |
| 441 | GTACAAGAACATGGAGGCAAAG | NTHI0741_fwd | 1069 |
| 442 | CTTTATTTGGGAATAAACGGTG | NTHI0741_rev | |
| 443 | CCTGCTGCTATTTCAATTATTC | NTHI0745_fwd | 811 |
| 444 | CTTGCGTGCTTCAACACTAC | NTHI0745_rev | |
| 445 | GCTGAAGCACTTAAGAAAGAATTAG | NTHI0762_fwd | 1153 |
| 446 | GAATAGGGTTTTATTTCTACATCATTG | NTHI0762_rev | |
| 447 | GAAAGAATGGAGCTGATTGC | NTHI0779_fwd | 1108 |
| 448 | GTTTGCTATGATGAAAAAGGC | NTHI0779_rev | |
| 449 | CCCTACAATTACTAATATCAACAATC | NTHI0782_fwd_a | 458 |
| 450 | CTTTAATATTGTTTGCTTGTTCTC | NTHI0782_rev_a | |
| 451 | CTAATATCAACAATCAACGGCTC | NTHI0782_fwd_b | 449 |
| 452 | GTCTTTAATATTGTTTGCTTGTTCTC | NTHI0782_rev_b | |
| 453 | GGGCAACAGGTGTATTTACTG | NTHI0816_fwd | 1246 |
| 454 | CGGTGAAAATTAACCGCAC | NTHI0816_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 455 | GCATTATGCAACCAGTAGAAG | NTHI0830_fwd | 1394 |
| 456 | GCGGTAAAAATTTGTTGAGA | NTHI0830_rev | |
| 457 | GTGGAACAAGTATTGAAAGATCC | NTHI0834_fwd | 735 |
| 458 | CTCTCTTAGTGCATCCGTTTC | NTHI0834_rev | |
| 459 | CACCGTTAGCCCAGAAATG | NTHI0870_fwd | 1043 |
| 460 | GCACTTTCAATCGCATTTAAG | NTHI0870_rev | |
| 461 | GATTCAGTAAGTAAACAGGCTTGG | NTHI0921_fwd | 1431 |
| 462 | CAAAAAAATGGAAAAAACATTTC | NTHI0921_rev | |
| 463 | GCAGCAGCTTTAGTGAAGAAAG | NTHI0945_fwd | 1069 |
| 464 | TTAAACGACAACGACCAACTG | NTHI0945_rev | |
| 465 | CGTTCTTTCTAAAGCGTATGG | NTHI0960_fwd | 1053 |
| 466 | CAAGCAATTGAATTACAATAGATG | NTHI0960_rev | |
| 467 | GGTCTAAAGACTCGGATTTGAG | NTHI1012_fwd | 1045 |
| 468 | GTCTAATGCTTTGAACGCTTG | NTHI1012_rev | |
| 469 | CGTCATAATATGGACGATTTAGC | NTHI1024_fwd | 848 |
| 470 | GTGGAGCGATGAATATCCTTG | NTHI1024_rev | |
| 471 | GTTAATTGGTGAACCAGGTGTAG | NTHI1028_fwd | 624 |
| 472 | GGTTCAGGTTTAGAATCTATTTCC | NTHI1028_rev | |
| 473 | GCAAAGGCTGGAAACTTTG | NTHI1030_fwd | 1059 |
| 474 | CATGATCTTGCATATATTC | NTHI1030_rev | |
| 475 | CAATTTAAACACGGAAGCAATG | NTHI1034_fwd | 1276 |
| 476 | GTGCAATTTTGCACGGTATATG | NTHI1034_rev | |
| 477 | GCACTTTTATCTGAACAAGATCG | NTHI1048_fwd | 961 |
| 478 | CTAAAGTGCGGTCAAGTTCTTC | NTHI1048_rev | |
| 479 | GCTTATTAGCGGAATTATCTGA | NTHI1059_fwd | 1557 |
| 480 | CTGGATATGCGGTACTCACTG | NTHI1059_rev | |
| 481 | GAATTTGATGAATATCGTAAGGC | NTHI1063_fwd | 1533 |
| 482 | GTAGAATCTAATACCTGCATAAAGG | NTHI1063_rev | |
| 483 | GTATTCTCTTATGCCAAACCAAT | NTHI1083_fwd | 977 |
| 484 | CAAAATCCCTGCTTTAGAATCT | NTHI1083_rev | |
| 485 | GGCATTGATTAGTGTAAATTTAGG | NTHI1084_fwd | 1047 |
| 486 | CTCCCAGATTACCTATAATGCG | NTHI1084_rev | |
| 487 | CATTTCTCTAACAATACTTTAGTAGGC | NTHI1085_fwd | 1171 |
| 488 | GGTATTCATCCGCTAATTTTG | NTHI1085_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 489 | GTTGAGCAAGCAGAACGC | NTHI1093_fwd | 668 |
| 490 | CGAACCACTTTTTCGTTCC | NTHI1093_rev | |
| 491 | GATTATTGAATTAGATGGTAGTCAGC | NTHI1094_fwd | 1051 |
| 492 | GTTGGTTTACCTTCCGCATC | NTHI1094_rev | |
| 493 | CAAAAGCCGATCCATATTG | NTHI1114_fwd | 781 |
| 494 | CACAATTTCACCATTTTAACC | NTHI1114_rev | |
| 495 | GATTATGCAAAGATAAACTTGAAC | NTHI1127_fwd | 879 |
| 496 | GAGCGGTTGTCATTCTTTCC | NTHI1127_rev | |
| 497 | GCGAATTTATCGTAGGCG | NTHI1145_fwd | 1051 |
| 498 | GCTCTTTCACTAAATCTACACCTG | NTHI1145_rev | |
| 499 | GTAGGAATGGCAGTTGCAGC | NTHI1160_fwd | 1048 |
| 500 | CAATATCCACTTGCCCTAATGC | NTHI1160_rev | |
| 501 | CTAATTGTTGAAGGAAGAGGAG | NTHI1164_fwd | 835 |
| 502 | CTTCATTATTTTCAGCAAAGTG | NTHI1164_rev | |
| 503 | GGGGAATTCAAACTAAAAATG | NTHI1168_fwd | 622 |
| 504 | CCTACACGCTGTTTTCTATGG | NTHI1168_rev | |
| 505 | GTATCATTTTTAGGACGTGCAA | NTHI1169_fwd | 761 |
| 506 | CCAAGTTCCTTTATACGTTGC | NTHI1169_rev | |
| 507 | CGAAAAATTATGGCAGAGACAC | NTHI1175_fwd | 1138 |
| 508 | GTGACAACAGGACCACGATAAC | NTHI1175_rev | |
| 509 | CTTGTTACCCACCAACCATC | NTHI1188_fwd | 1386 |
| 510 | CTTTGGTTTCACTGTTGAAAAC | NTHI1188_rev | |
| 511 | CATCTTTAATTTATTCATAAATACAAAATT | NTHI1199_fwd | 1519 |
| 512 | CACCTCAAAAACTCACCGC | NTHI1199_rev | |
| 513 | GAACCCATAAATTGGTTTGTCC | NTHI1207_fwd | 1049 |
| 514 | CACCACCATAGGTATAATCTAAACC | NTHI1207_rev | |
| 515 | CAAATTCATACCGCACTTTTAAG | NTHI1231_fwd | 853 |
| 516 | CAATCACCAACTCTTCACGC | NTHI1231_rev | |
| 517 | CAATTCAAGTGATTCCACATATC | NTHI1238_fwd | 1294 |
| 518 | GATTTTTGTGATTTTCATAGGC | NTHI1238_rev | |
| 519 | CGATTTATGCCCCTTTAATG | NTHI1244_fwd | 1552 |
| 520 | CTTTCTTGTAGAAAAATACGTTTCT | NTHI1244_rev | |
| 521 | GATTTCGTTGAGGTTTTGGTC | NTHI1253_fwd | 1058 |
| 522 | GAAAGCAATGCTGAAAGTAATG | NTHI1253_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR product size |
|---|---|---|---|
| 523 | CAAGGTGTTATACTGACTGAAGAAC | NTHI1265_fwd | 1112 |
| 524 | CGAGGTGCTTTAGAAATAAATC | NTHI1265_rev | |
| 525 | GGAAACCAGATTTTAATTCATTAAG | NTHI1266_fwd | 1345 |
| 526 | CGTATTCATATTGGCGCAAG | NTHI1266_rev | |
| 527 | GATGCGATTCCTCGCTTAG | NTHI1286_fwd | 1388 |
| 528 | GAATTAAAAGATTACTGGGAATTG | NTHI1286_rev | |
| 529 | CAGGTTACGATAGCACAATTAGC | NTHI1292_fwd | 1183 |
| 530 | CACGTTATCAAAAGGTGCTTTC | NTHI1292_rev | |
| 531 | GTTCTACGGTAAAACCTTTCG | NTHI1299_fwd | 1055 |
| 532 | CTCAGAAACCACCGCACTC | NTHI1299_rev | |
| 533 | CACAAGAATCAAAAGTGAATTAAG | NTHI1300_fwd | 975 |
| 534 | CGTGGTCATTACTAATAATAAATTACTT | NTHI1300_rev | |
| 535 | CACAAGGTGCTGGTAGCG | NTHI1308_fwd | 1166 |
| 536 | CCAAGTAAAAAAAAGACACCAAG | NTHI1308_rev | |
| 537 | CTTATTTTTCGGCGGCTATTT | NTHI1323_fwd | 1664 |
| 538 | GATGGGAAATTTATTCAAGAACAG | NTHI1323_rev | |
| 539 | GAGCATATTGAAAATGCCACTG | NTHI1326_fwd | 964 |
| 540 | GTTTCAAATCTTCAATTCGGTG | NTHI1326_rev | |
| 541 | GGTAGCAATGAGGCAAATTC | NTHI1332_fwd | 1422 |
| 542 | GAACCTTTCATATAAATAAGAATGG | NTHI1332_rev | |
| 543 | CAGACACTTGCCATCAATTTG | NTHI1342_fwd | 915 |
| 544 | GCTGCAGGGACTTATCGAG | NTHI1342_rev | |
| 545 | CTTCTAAACGTGTTTCCTCTCT | NTHI1390_fwd | 1231 |
| 546 | CAAATTTTAATAAATGGCTACG | NTHI1390_rev | |
| 547 | CTTTTCAATGTGGGTTGGTATC | NTHI1403_fwd | 1102 |
| 548 | CCGCACTTTTTTCATCTTTC | NTHI1403_rev | |
| 549 | CTAAATAATGTAAAAAATGACCGC | NTHI1423_fwd | 1456 |
| 550 | CCAACAAATGAACCATTGCC | NTHI1423_rev | |
| 551 | GGTACTGCTTGAACATTTTAATTC | NTHI1448_fwd | 1064 |
| 552 | CAAGTGCTTTCGTTTCCATT | NTHI1448_rev | |
| 553 | GATGGACAGCAGTAGTCAGTAATT | NTHI1449_fwd | 950 |
| 554 | CTGGTATAAAGGCTTAAGGATTG | NTHI1449_rev | |
| 555 | CTCTGCTAACGATCACAATGTG | NTHI1450_fwd | 1066 |
| 556 | CACATCAATTTCAGCACCTTT | NTHI1450_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR procuct size |
|---|---|---|---|
| 557 | CAAACCAATCTTTATGTTTTACG | NTHI1458_fwd | 1552 |
| 558 | CCGCACTTTCATTCCATTC | NTHI1458_rev | |
| 559 | GAATATGAATGGCGTTTTAATC | NTHI1474_fwd | 1296 |
| 560 | GCATTAAAGTCTAATATGATTAATCAG | NTHI1474_rev | |
| 561 | CTAATCCAAACGAAAAAATAAGTC | NTHI1512_fwd | 1146 |
| 562 | CAGAGAGATAATCCGCTTCG | NTHI1512_rev | |
| 563 | GGGGTTAAGTCTTGATGATACG | NTHI1542_fwd | 980 |
| 564 | CAGAATAAAGCGGTAGGAATTTC | NTHI1542_rev | |
| 565 | CTAATTATGAAGCAGGCTGGG | NTHI1552_fwd | 1051 |
| 566 | CCATTAAAAAAGCGTGTTTTG | NTHI1552_rev | |
| 567 | CGGTGAAATGGYATCGCAAAG | NTHI1569_fwd | 927 |
| 568 | CCTCTATTTAGCTTGCCATAATATTCG | NTHI1569_rev | |
| 569 | CTCGTTTAGATTAGATAAAAAATTTAC | NTHI1593_fwd | 1089 |
| 570 | CAAAAGCCACATCATATTCAAG | NTHI1593_rev | |
| 571 | CATTTGGGCTGCCTGAAG | NTHI1638_fwd | 1313 |
| 572 | GGGCCATAGCAACAAATTC | NTHI1638_rev | |
| 573 | CAAGCATCTCCTGTAATTTATTT | NTHI1667_fwd | 1049 |
| 574 | CAATATTATCGAAATCGCTATAAT | NTHI1667_rev | |
| 575 | CCTAGCTTGTGCTATGTTAGATATG | NTHI1702_fwd | 960 |
| 576 | GTTATCCACAAGTGTGCAAATG | NTHI1702_rev | |
| 577 | GTTGTAATTTATTAGGCATTAAACC | NTHI1707_fwd | 1265 |
| 578 | CGCTTGTGATTAAATGGTTTAC | NTHI1707_rev | |
| 579 | CGATTACATCAAGAACTGAAAGG | NTHI1746_fwd | 1159 |
| 580 | GATTCTACACCTGAATTACCGC | NTHI1746_rev | |
| 581 | CGATGAATATGTGGATCGTG | NTHI1760_fwd | 732 |
| 582 | GTGATTAACACATCCGTTGG | NTHI1760_rev | |
| 583 | GAAAACTTACCAACTTTTATTAAACC | NTHI1774_fwd | 1412 |
| 584 | CAAAGCAAACAATGCCGTAG | NTHI1774_rev | |
| 585 | CGGCATGATGTTCGATTTAG | NTHI1784_fwd | 710 |
| 586 | GAGTTTGTTGGGCATCTAATG | NTHI1784_rev | |
| 587 | CTTTTGCAGGCGTAACCC | NTHI1809_fwd | 1040 |
| 588 | CGTCAAAAAGGCAAAGTTCTAC | NTHI1809_rev | |
| 589 | CCCTTAGATTTGTATAGAATAGCC | NTHI1812_fwd | 972 |
| 590 | CGTAAACCTGAAATGGTTGG | NTHI1812_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR product size |
|---|---|---|---|
| 591 | GAAATTGTTCTATTCAATATAATTGATAG | NTHI1816_fwd | 1215 |
| 592 | GGAAAATGAAAGCCTGATTG | NTHI1816_rev | |
| 593 | CGCCATTTGTATTTAAGCTG | NTHI1825_fwd | 1697 |
| 594 | CATTCGGTTCAATATGTAGTTCTG | NTHI1825_rev | |
| 595 | CAAGAATTCAACCCCACCAC | NTHI1838_fwd | 810 |
| 596 | CCCCAATCCCCCTAAATTC | NTHI1838_rev | |
| 597 | GATATTTAATGAATGCGCTTG | NTHI1849_fwd | 1132 |
| 598 | CAGGGAATAGAAGAGTTTGAGC | NTHI1849_rev | |
| 599 | GAACTGAAAGAATGGTTTCAAAC | NTHI1857_fwd | 1077 |
| 600 | CGCCATTAATGCTTTCGTT | NTHI1857_rev | |
| 601 | CGATTTAGCCAAACAAAAGC | NTHI1885_fwd | 1435 |
| 602 | GGTAGATAGTCAGGCAAAATTTG | NTHI1885_rev | |
| 603 | CGACAAATTACGCGTAGGC | NTHI1905_fwd | 1061 |
| 604 | GAACCTATTGTGTATCGATTTGATG | NTHI1905_rev | |
| 605 | GATGACTTACGCTTCAAAAAGTG | NTHI1915_fwd | 1322 |
| 606 | GGTAGAACGGTGGACTGTTAATC | NTHI1915_rev | |
| 607 | CGCCTACACCTAAATGAGGC | NTHI1925_fwd | 1058 |
| 608 | CTTTTGCGTTTTCGGCTAAG | NTHI1925_rev | |
| 609 | GCAAAAATTGAACTTTCATCAG | NTHI1929_fwd | 1120 |
| 610 | GAAGAGCGGTGAATTATTTATTATC | NTHI1929_rev | |
| 611 | CAGTTTCAGCTTTCAAGCCTC | NTHI1945_fwd | 1499 |
| 612 | CTTTACCCACTTTTAATCGACAC | NTHI1945_rev | |
| 613 | GTAGAGGAAAATGGAAAACGTG | NTHI1955_fwd | 1053 |
| 614 | GGTGCATTAGAACAAGCGG | NTHI1955_rev | |
| 615 | CACAAATTGGTTTACTCTTGCC | NTHI1957_fwd | 877 |
| 616 | CTTAAAATCCCTGTTAAGCCACT | NTHI1957_rev | |
| 617 | GTTTGAAATCTAAAGAGTTTGAACTAG | NTHI1964_fwd | 694 |
| 618 | CATTTTCTGCTCCATATCCTG | NTHI1964_rev | |
| 619 | ATAAAAATAATGCCGAAATCC | NTHI1983_fwd | 1042 |
| 620 | GAACCCTTCACGGTAGTTAAA | NTHI1983_rev | |
| 621 | CACAGCCTCCATTACACCAC | NTHI1994_fwd | 1039 |
| 622 | GAGTACAAGCATTGTTGCTAAAC | NTHI1994_rev | |
| 623 | CAACAGGCGAAATCGGTAAA | NTHI2041_fwd | 625 |
| 624 | CCAAAGTGCGGTGCTAATTC | NTHI2041_rev | |

TABLE 7-continued

PCR primer sequences used for the analysis of the conservation in 47 NTHi isolates of the 156 immunogenic NTHi ORFs identified by screening bacterial display libraries of the fragmented genome of NTHi 86-028NP with human immunoglobulin
The table provides sequences for the oligonucleotide primers used to examine the conservation of 156 antigenic NTHi ORFs, by PCR. The table lists a total of 157 PCR primer pairs, i.e. 314 oligonucleotide sequences (2 primer pairs were used for ORF NTHI0782).

| SEQ ID NO | DNA oligonucleotide sequence (5'-3') | Oligonucleotide name (ORF name_oligo sense) | PCR product size |
|---|---|---|---|
| 625 | CTAAGATAGATAAAATTAAATTAAGTAAAAAC | NTHI2048_fwd | 1327 |
| 626 | CCCGCATAAATAAGTAAAGCC | NTHI2048_rev | |

TABLE 8

List of *Haemophilus influenzae* genes selected for expression.

| Nr. of construct | Name of construct | Vector | RE | DNA (start/stop) | Protein (start/stop) | SEQ ID NO (DNA) | SEQ ID NO (protein) |
|---|---|---|---|---|---|---|---|
| 1 | NTHI0007-1 | pET28b(+) | NcoI/XhoI | 97-2574 | 33-858* | 630, 631 | 650, 651 |
| 2 | NTHI0007-2 | pET28b(+) | NcoI/XhoI | 2548-3084 | 850-1028 | 632 | 652 |
| 3 | NTHI0358-1 | pET28b(+) | NcoI/NotI | 76-792 | 26-264 | 633 | 653 |
| 4 | NTHI0369-1 | pET28b(+) | NcoI/XhoI | 64-2127 | 22-709** | 634, 635 | 654, 655 |
| 5 | NTHI0370-1 | pET28b(+) | NcoI/XhoI | 79-1695 | 27-565 | 636 | 656 |
| 6 | NTHI0371-1 | pET28b(+) | NcoI/NotI | 67-897 | 23-299 | 637 | 657 |
| 7 | NTHI0525 | pET28b(+) | NcoI/XhoI | 1-1290 | 1-430*** | 638, 639 | 658, 659 |
| 8 | NTHI0716-1 | pET28b(+) | NcoI/XhoI | 70-945 | 24-315 | 640 | 660 |
| 9 | NTHI0782-1 | pET28b(+) | NcoI/NotI | 85-1230 | 29-410 | 641 | 661 |
| 10 | NTHI0782-4 | pET28b(+) | NcoI/XhoI | 2050-2976 | 684-992 | 642 | 662 |
| 11 | NTHI0830-1 | pET28b(+) | NcoI/XhoI | 55-1215 | 19-405 | 643 | 663 |
| 12 | NTHI1063-1 | pET28b(+) | NcoI/XhoI | 4-1170 | 2-390 | 644 | 664 |
| 13 | NTHI1164-2 | pET28b(+) | NcoI-BspHI/XhoI | 1777-3075 | 593-1025 | 645 | 665 |
| 14 | NTHI1169-2 | pET28b(+) | NcoI/XhoI | 754-1890 | 252-630 | 646 | 666 |
| 15 | NTHI1342-1 | pET28b(+) | NcoI/XhoI | 64-510 | 22-170 | 647 | 667 |
| 16 | NTHI1390-1 | pET28b(+) | NcoI/XhoI | 85-900 | 29-300 | 648 | 668 |
| 17 | NTHI1667-1 | pET28b(+) | NcoI/XhoI | 64-573 | 22-191 | 649 | 669 |

The nomenclature of the genes is derived from the published genome of *Haemophilus influenzae* strain 86-028NP. The restriction sites (RE) used for cloning and the position (start/stop) of the amplicons are indicated for each construct.
*The residue Threonine at position 624 relative to the native protein ("wild-type" fragment, DNA/protein: SEQ ID NO 630, 650) was changed to a Proline according to the sequence confirmation of the expression construct ("mutated" fragment, DNA/protein: SEQ ID NO 631, 651). Notably, here the residue Selenocysteine at position 204 relative to the native protein was changed to a Cysteine to achieve expression in the *E. coli* expression host.
**The residue Threonine at position 310 relative to the native protein ("wild-type" fragment, DNA/protein: SEQ ID NO 634, 654) was changed to a Alanine according to the sequence confirmation of the expression construct ("mutated" fragment, DNA/protein: SEQ ID NO 635, 655).
***The residue Proline at position 337 was changed to a Leucine and Arginine at position 373 relative to the native protein ("wild-type" fragment, DNA/protein: SEQ ID NO 638, 658) was changed to a Histidine according to the sequence confirmation of the expression construct ("mutated" fragment, DNA/protein: SEQ ID NO 639, 659). Mutations could be due to PCR amplification or be mutations in the particular 86-028NP strain used for PCR amplification.

EXAMPLES

Example 1

General Screening Procedure for the Identification of Antigenic Bacterial Proteins According to the Present Invention The approach, which has been employed for the present invention, is based on the interaction of proteins or peptides encoded by *H. influenzae* with the antibodies present in human sera. The antibodies produced against *H. influenzae* by the human immune system and present in human sera are indicative of the in vivo expression of the antigenic proteins and their immunogenicity. In addition, the antigenic proteins, as identified by the bacterial surface display expression libraries using pools of pre-selected sera, are processed in a second and third round of screening by individual selected or generated sera. Thus the present invention supplies an efficient, relevant, comprehensive set of antigens as a pharmaceutical composition, especially a vaccine preventing infections caused by *H. influenzae*.

In the antigen identification program for identifying a comprehensive set of antigens according to the present invention, at least two different bacterial surface expression libraries from *H. influenzae* are screened with several serum pools or plasma fractions (antibody pools). The antibody pools are derived from a serum collection, which has been tested against antigenic compounds of *H. influenzae*, such as whole cell, total extracts. Sera determined to have high ELISA titre have to react with multiple proteins in immunoblotting in order to be considered relevant in the screening method applied for the present invention.

The expression libraries as used in the present invention should allow expression of all potential antigens, e.g. derived from all secreted and surface proteins of *H. influenzae*. Bacterial surface display libraries will be represented by a recombinant library of a bacterial host displaying a (total) set of expressed peptide sequences of *H. influenzae* on two selected outer membrane proteins (LamB and FhuA) at the bacterial host membrane (Georgiou, G., 1997; Etz, H. et al., 2001). One of the advantages of using recombinant expression libraries is that the identified serum-reactive antigens may be instantly produced by expression of the coding sequences of the screened and selected clones expressing the antigens without further recombinant DNA technology or cloning steps necessary.

The comprehensive set of antigens identified by the described program according to the present invention may be analysed further by one or more additional rounds of screening. Therefore individual antibody preparations or antibodies generated against selected peptides, which were identified as immunogenic can be used. According to a preferred embodiment the individual antibody preparations for the second round of screening are derived from healthy adults and/or challenged adults who show an antibody titre above a certain minimum level, for example an antibody titre being higher than 80 percentile, preferably higher than 90 percentile, especially higher than 95 percentile of the human (patient or healthy individual) sera tested. Using such high titre individual antibody preparations in the second screening round allows a very selective identification of the antigens and fragments thereof from *H. influenzae*.

Following the comprehensive screening procedure, the selected antigenic proteins, expressed as recombinant proteins, or—in case they can not be expressed in prokaryotic expression systems—in vitro translated products, or synthetically produced antigenic peptides can be tested in a second screening by a series of ELISA and Western blotting assays for the assessment of their immunogenicity with a large human serum collection (minimum ~20 healthy and patients sera).

It is important that the individual antibody preparations (which may also be the selected serum) allow a selective identification of the most promising candidates of all the serum-reactive antigens from all the promising candidates from the first round. Therefore, preferably at least 10 individual antibody preparations (i.e. antibody preparations (e.g. sera) from at least 10 different individuals exposed to the chosen pathogen) should be used in identifying these antigens in the second screening round. Of course, it is possible to use also less than 10 individual preparations, however, selectivity of the step may not be optimal with a low number of individual antibody preparations. On the other hand, if a given antigen (or an antigenic fragment thereof) is recognized by at least 10 individual antibody preparations, preferably at least 30, especially at least 50 individual antibody preparations (in this case 22), identification of the antigen is also selective enough for a proper identification. Serum-reactivity may of course be tested with as many individual preparations as possible (e.g. with more than 100 or even with more than 1,000).

Therefore, the relevant portion of the antibody preparations according to the method of the present invention should preferably be at least 10, more preferably at least 30, especially at least 50 individual antibody preparations. Alternatively (or in combination) antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titre against *H. influenzae* (e.g. against a preparation of this pathogen, such as a lysate, cell wall components and recombinant proteins). Preferably, some are selected with high IgG titres, calculated from the OD reading at a given dilution when the whole organism (total lysate or whole cells) is used as antigen in the ELISA.

The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens for extracellular bacteria are located on the cell surface or secreted, and are therefore accessible extracellularly. Antigens from bacteria with an intracellular stage in host cells may also be derived from intracellular locations, but need to be presented on the host cell as antigens. Antibodies against cell wall proteins are expected to serve multiple purposes: to inhibit adhesion, to interfere with nutrient acquisition, to inhibit immune evasion and to promote phagocytosis (Foxwell et al., 1998; Murphy 2005; Rao et al., 1999; Cripps 2006). Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within infection causing pathogen species. Bioinformatic analyses (signal sequences, cell wall localisation signals, and transmembrane domains) proved to be very useful in assessing cell surface localisation or secretion. The experimental approach includes the isolation of antibodies with the corresponding epitopes and proteins from human serum, and the generation of immune sera in mice against recombinant proteins selected on the basis of results from the bacterial surface display screens. These sera are then used in a third round of screening as reagents in at least one of the following assays: cell surface staining of *H. influenzae* grown under different conditions (FACS or microscopy), determination of neutralizing capacity (toxin, adherence), and promotion of opsonisation and serum bactericidal activity.

For that purpose, recombinant proteins made on the basis of results from screening of the *E. coli* libraries are injected into mice and immune sera are taken and tested in the relevant in vitro assay. Alternatively, specific antibodies may be purified from human or mouse sera using peptides or proteins as substrate.

According to the antigen identification method used herein, the present invention can surprisingly provide a set of comprehensive novel nucleic acids and novel proteins, antigens and fragments thereof of *H. influenzae*, among other things, as described herein. The nucleotide sequences according to the present invention encoding such antigens have preferably a nucleotide sequence which is individually set forth in SEQ ID NOs 636 to 641, 643, 646, 648 or 1 to 156 (Table 8, Table 4), whereby the corresponding encoded amino acid sequences have an amino acid sequence as set forth in SEQ ID NOs 656 to 661, 663, 666, 668 or 157 to 312 (Table 8, Table 4).

All linear fragments of a particular antigen may be identified by analysing the entire sequence of the protein antigen by a set of peptides overlapping by 1 amino acid with a length of at least 10 amino acids. Subsequently, non-linear epitopes can be identified by analysis of the antigen with sera using the expressed full-length protein or domain polypeptides thereof. Assuming that a distinct domain of a protein is sufficient to form the 3D structure independent from the native protein, the analysis of the respective recombinant or synthetically produced domain polypeptide with serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

Subsequent sequencing of a larger number of randomly picked clones (approx. 600 clones per screen) led to the identification of the gene and the corresponding peptide or protein sequence that was specifically recognized by the human serum antibodies used for screening. The frequency with which a specific clone is selected reflects at least in part the abundance and/or affinity of the specific antibodies in the serum used for selection and recognizing the epitope presented by this clone. Table 4 summarizes the data obtained for the two performed screens.

It is further worth noticing that a large number of the genes identified by the bacterial surface display screen encode proteins of *H. influenzae*, which have no assigned function or may even constitute proteins, which have not been predicted by previous bioinformatic analysis. Thus, many of these candidates constitute novel antigenic proteins of *H. influenzae*.

Example 2

Characterization and Selection of Human Serum Samples Based on Anti-NTHi Antibodies and Preparation of Antibody Screening Reagents Experimental Procedures
Human Serum Collection.

From 167 otitis media patients, middle ear fluid, sinus fluid and serum were obtained. Routine clinical examination and microbiology were used to establish clinical status and infection status with NTHi. Serum samples were also collected from 49 children with history of asthma but without history of otitis media for the last months, and a total of 13 serum samples were collected from children with no recent episode of acute otitis but with a history of recurrent otitis media. Finally, 85 serum samples were obtained from patients with respiratory allergies, and 54 serum samples were collected from healthy exposed individuals without oropharyngeal NTHi colonization, to serve as a reference for functional (protective) antibodies.

Serum samples were stored at −80° C. for long term storage, or at 4° C. with the addition of 0.05% sodium azide for short term storage for use in ELISA.
Enzyme-Linked Immunosorbent Assay (ELISA).

NTHi strain 86-028NP was grown in liquid medium at 37° C., 5% $CO_2$ until a late log phase was reached. Cells were harvested by centrifugation (1,000×g, 10 min, 4° C.) and washed twice with PBS. Bacteria were re-suspended in PBS containing protease inhibitors and then lysed on ice by sonication (2 min, pulse 5, 100% power). The supernatant was collected by centrifugation (1,000×g, 15 min, 4° C.). The protein concentration was determined by Bradford assay.

ELISA plates (Maxisorb, Millipore) were coated with 5-10 μg/ml total protein diluted in coating buffer (0.1M sodium carbonate pH 9.2). Two dilutions of sera (10,000×, 50,000×) were made in 1% BSA, PBS. Highly specific Horse Radish Peroxidase (HRP)-conjugated anti-human IgG secondary antibodies (Southern Biotech, U.S.A.) were used according to the manufacturer's recommendations (dilution: 1,000×). Antigen-antibody complexes were quantified by measuring the conversion of the substrate (ABTS) to colored product based on OD405 nm readings by automatic ELISA reader (TECAN SUNRISE, Austria).
Immunoblotting.

Bacteria were solubilised by adding SDS-PAGE sample buffer containing SDS and 2-mercaptoethanol, and heat-denatured. Approximately 5 μg total proteins were separated by SDS-PAGE using the BioRad Mini-Protean 3 Cell electrophoresis system and proteins were transferred to nitrocellulose or PVDF membranes. After overnight blocking in 5% milk, human sera were added at between 1:1,000 and 1:5,000× dilution, and HRP labelled anti-human IgG was used for detection.
Purification of Antibodies for Genomic Screening.

For purification of immunoglobulin (IgGs), human serum pools were heat-inactivated at 56° C. for 30 min and centrifuged to remove precipitated proteins. The supernatant was passed through a 0.2 μm filter. Antibodies against *E. coli* proteins were removed by incubating the heat-inactivated sera with whole cell *E. coli* cells (DH5alpha, transformed with pHIE11, grown under the same condition as used for bacterial surface display). *E. coli* cells in the logarithmic growth phase were collected by centrifugation from a 100 ml culture, washed twice with PBS and re-suspended in PBS to a final volume of approximately 100 μl. One ml serum and 100 μl of bacterial cell suspension are mixed and incubated for 6 to 15 hrs at 4° C. under continuous agitation (Rotator Drive STR4, Stuart Scientific). After centrifugation at 8,000 rpm at 4° C. for 10 min, the supernatant is transferred into a new tube and depletion repeated twice using the same volume of *E. coli* cell suspension. Finally, bacterial cells are removed by centrifugation and the serum filtered through a 0.22 μm Spin-x® filter (Costar, U.S.A.).

For IgG purification, samples were diluted 1:3 with Binding Buffer (Pierce, U.S.A.) and applied to equilibrated Ultralink Immobilized Protein G columns (Pierce, #53125). A volume of binding solution containing 1 ml serum was applied to 1 ml Protein G beads. After washing the column with 20 bed volumes of Binding Buffer, bound IgGs were recovered by elution with Elution Buffer (Pierce, U.S.A.). The eluted fractions were adjusted immediately to physiologic pH by adding 1/10 of the volume of Neutralization Buffer. Samples with the highest absorbance were pooled and dialyzed against PBS.

The efficiency of depletion and purification was checked by 12% SDS-PAGE and the protein concentration was determined by comparison to a BSA standard on the same SDS-PAGE analysis. Pooled IgG fractions were biotinylated according to the manufacturer's instructions (EZ-Link Sulfo-NHS-LC-Biotin, Pierce) and the biotinylation controlled by qualitative Western blot analysis.
Results Human sera, collected from otitis media patients, people suffering from respiratory allergies and healthy individuals, were analysed by ELISA on NTHi lysate. The high titer sera were further analysed by Western blot (FIG. 1).

The sera giving strong signals in Western blot analysis with NTHi antigen were selected (FIG. 1). Additionally, ELISA and Western blot analysis were used to identify sera with high reactivities against other pathogens associated with otitis media, e.g. *Moraxella catarrhalis* and *Streptococcus pneumoniae*. In total, 3 different serum pools were generated based on the available clinical diagnosis. All 3 pools comprised sera with high NTHi reactivity and low *Moraxella catarrhalis* reactivity. Also, only pool P38 exhibited *Streptococcus pneumoniae* reactivity.

Pool IC21 consisted of individual sera IC33, IC35, IC54, IC112 and IC119 (healthy individuals). Pool P38 consisted of individual sera P3931, P3934, P3946, P3947 and P3970 (children with asthma, age: 5-17 yrs). Pool P40 consisted of individual sera P4034.2, P4060.2, P4063.2, P4073.2 and P4088.2 (patients recovering from otitis media).

The serum pools were then preadsorbed on *E. coli* to remove anti-*E. coli* antibodies, including antibodies against the FhuA and LamB proteins used as scaffolds in the surface display libraries, and thereby reduce nonspecific binding in the subsequent MACS screening. Following preadsorption, human IgGs were purified, and biotinylated.

The IgG concentrations in each serum pool obtained after biotinylation were: Pool IC21, 0.50 mg/ml. Pool P38, 0.18 mg/ml. Pool P40, 0.23 mg/ml.

These serum pools were used for MACS screening of the NTHi 86-028NP surface display libraries.

Example 3

Generation of Highly Random, Frame-Selected, Small-Fragment, Genomic DNA Libraries of *H. influenzae*

Experimental Procedures

Preparation of genomic DNA from *H. influenzae*.

Genomic DNA from NTHi 86-028NP was prepared using standard protocols. Briefly, cells from a 50 ml culture in sBHI medium (Brain heart infusion medium supplemented with 10 µg/ml NAD$^+$ and 10 µg/ml hemin) were harvested by centrifugation and resuspended in 8 ml TE buffer. After addition of 1 ml 10% SDS and 0.5 ml proteinase K (20 mg/ml) the solution was incubated at 37° C. for 1 h, followed by repeated phenol/chloroform extractions (at least twice). Genomic DNA was precipitated by adding 1/10 volumes of 3 M sodium acetate (pH 5.3) and 2 volumes of absolute ethanol, transferred to 70% ethanol using a sterile loop and centrifuged. The pellet was dried, redissolved in 1 ml TE buffer containing 0.2 mg/ml RNaseA and incubated at 37° C. for 30 min to remove residual RNA. The DNA was ethanol precipitated again and finally dissolved in 0.5 to 1 ml Tris/HCl buffer (10 mM, pH 8.5).

Preparation of Small Genomic DNA Fragments from NTHi 86-028NP.

Depending on the desired size different methods were used for the random fragmentation of genomic DNA. Fragments ranging in size between 150 and 300 bp were obtained by sonication of approx. 100 µg DNA in 5×50 µl Tris/HCl (10 mM, pH 8.5) using a cup-horn sonicator (Bandelin Sonoplus UV 2200 sonicator equipped with a BB5 cup horn, 10 sec. pulses at 100% power output). However, despite extensive exposure of the DNA to ultrasonic wave-induced hydromechanical shearing force, subsequent decrease in fragment size could not be efficiently and reproducibly achieved. Therefore, fragments of 50 to 150 bp in size were obtained by mild DNase I treatment using Novagen's shotgun cleavage kit. According to the manufacturer's instructions, preliminary tests using different DNase I dilutions were performed and evaluated on a 2% TAE agarose gel. The determined optimum conditions were applied for cleavage of approx. 100 µg DNA. This treatment resulted in total fragmentation of genomic DNA into near 50-150 bp fragments.

Following fragmentation, the DNA was separated on 5% TBE polyacrylamide gels or 2% TAE agarose gels (after DNase cleavage only), the areas corresponding to DNA fragments of 50-150 bp and 150-300 bp, respectively, were cut out and the DNA isolated using the QiaExII kit (Qiagen, Hilden, Germany).

To remove overhanging ends, the isolated fragments were then incubated with T4 DNA polymerase in the presence of dNTPs (100 µM each), followed by phenol/chloroform extraction and ethanol precipitation. The fragments were used immediately in ligation reactions or frozen at −20° C. for subsequent use.

Description of the Vectors.

The vector pMAL4.31 was constructed on a pASK-IBA backbone (Skerra 1994) with the beta-lactamase (bla) gene exchanged with the Kanamycin resistance gene. In addition, the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane (Kajava et al., 2000). A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that transcription of the bla gene stops 15 bp after the NotI site. A 3n+1 bp insertion restores the bla ORF so that beta-lactamase protein is produced with a consequent gain of Ampicillin resistance.

The vector pMAL9.1 was constructed by cloning the lamB gene into the multiple cloning site of pEH1 (Etz et al., 2001). Subsequently, a linker containing the restriction sites FseI, SmaI and NotI was inserted in lamB after the sequence coding for serine-155 by PCR mutagenesis. The reading frame for this insertion was constructed in such a way that transfer of frame-selected DNA fragments excised by digestion with FseI and NotI from plasmid pMAL4.31 yields a continuous reading frame of lamB and the respective insert.

The vector pHIE11 was constructed by cloning the fhuA gene into the multiple cloning site of pEH1 (Etz et al., 2001). Subsequently a sequence was inserted in fhuA after the sequence coding for proline-405, containing the restriction site FseI, XbaI and NotI. Vector pHIE14 differs from pHIE11 by an additional sequence of 162 bp cloned into the XbaI site. As described above for pMAL9.1, cloning of a 3n+1 bp fragment into the FseI and NotI sites results in a continuous reading frame of fhuA and the respective insert.

Cloning and Evaluation of the Library for Frame Selection.

Genomic DNA fragments from NTHi 86-028NP were ligated into the SmaI site of the vector pMAL4.31. Recombinant DNA was electroporated into DH10B electrocompetent *E. coli* cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and Evaluation of the Library for Bacterial Surface Display.

Genomic DNA fragments were excised with the restriction enzymes FseI and NotI from the pMAL4.31 vector, containing the *H. influenzae* library. The entire population of fragments was then transferred into plasmids pMAL9.1 (LamB) or pHIE11 (FhuA), which have been digested with FseI and NotI. Using these two restriction enzymes, which recognize an 8 bp GC rich sequence, the reading frame that was selected in the pMAL4.31 vector is maintained in each of the platform vectors. The plasmid library was then transformed into *E. coli* DHSalpha cells by electroporation. Cells were plated onto large LB-agar plates supplemented with 50 μg/mL Kanamycin and grown over night at 37° C. at a density yielding clearly visible single colonies. Cells were then scraped off the surface of these plates, washed with fresh LB medium and stored in aliquots for library screening at −80° C.

Results

Bacterial Surface Display Libraries

Ligation and subsequent transformation of approximately 1 μg of pMAL4.31 frame selection plasmid DNA and approximately 50 ng of fragmented and blunt-ended genomic NTHi 86-0828NP DNA yielded $2 \times 10^5$ to $6 \times 10^5$ clones after frame selection. Based on the frame-selected DNA, two libraries (LHi 50/2 and LHi 250) were generated in the pMAL9.1 (LamB) or pHIE11 (FhuA) display vectors, respectively. Frame-selected genomic DNA fragments were excised with FseI and NotI restriction digest, and approximately 5 ng fragments were ligated with 0.1 μg display plasmid DNA (pMAL9.1, LamB display scaffold, or pHIE11, FhuA display scaffold). Transformation into DHSalpha cells resulted in approximately 648,500 clones (LHi 50/2 library) and 200,000 clones (LHi 250 library). For each library, colonies were scraped off LB plates, pooled and frozen without further amplification.

To assess the size distributions and NTHi genome coverage of the libraries, randomly chosen library clones were sequenced (FIG. 2). The LHi 50/2 and LHi 250 libraries exhibited average insert sizes of 68 and 173 bp, respectively (FIG. 2). Thus, the coverage of the NTHi genome by these libraries was at least 10-fold (FIG. 2). The displayed inserts were distributed equally along the complete genome of NTHi 86-028NP (FIG. 2).

Example 4

Identification of Highly Immunogenic Peptide Sequences from NTHi Using Bacterial Surface Display Genomic Libraries and Human Sera Experimental Procedures MACS Screening.

Approximately $1 \times 10^8$ colony-forming units from a given library were grown in 5 mL LB-medium supplemented with 50 μg/mL Kanamycin at 37° C. for 50 min (FhuA library) and 30 min (LamB library), respectively. Expression was induced by the addition of 1 mM IPTG for 40 min (FhuA) and 2 h (LamB), respectively. Cells were washed twice with fresh LB medium and approximately $8 \times 10^6$ cells re-suspended in 100 μL LB medium and transferred to an Eppendorf tube.

An amount of 20 μg of biotinylated, human IgGs was added to the cells and the suspension incubated overnight at 4° C. with gentle shaking. The cells were harvested, washed twice with 1 ml LB-Kan, and resuspended in 100 μl LB-Kan. An amount of 15 μl of streptavidin coupled microbeads (Miltenyi Biotec) were added and the mixture was incubated at 4° C. for 45 min. The MACS microbead cell suspension was washed once, resuspended in 1 ml LB-Kan and loaded onto pre-equilibrated MACS separation columns MS (Miltenyi Biotec) which was fixed to the magnet (the MS columns were equilibrated by washing with 3 ml 70% ethanol and 2×3 ml LB-Kan).

The columns were then washed three times with 3 ml LB-Kan, and elution was performed with 2 ml LB-Kan by removing the magnet. After washing the columns three times with LB-Kan, the eluate was reloaded, washed and eluted as before. Aliquots of the final eluate after three column binding/elution rounds were plated on LB-Kan agar plates and grown over night at 37° C.

Evaluation of Selected Clones by Sequencing and Western Blot Analysis.

Randomly selected clones were grown overnight at 37° C. in 200 μl LB medium supplemented with 50 μg/mL Kanamycin. Bacterial clones on LB/Kan agar were used for sequencing at Agowa (Germany).

For Western blot analysis, library *E. coli* clones were pre-cultured in LB-Kan and induced with 1 mM IPTG for 2 h (FhuA) or 4 h (LamB). *E. coli* library clones which were shown by DNA sequence analysis not to display peptides, but did display the FhuA or LamB scaffold proteins as appropriate, served as negative controls in Western. Approximately 10 to 20 μg of total bacterial protein was separated by 10% SDS-PAGE and blotted onto PVDF membranes (Amersham Pharmacia Biotech, England). The reactivity of peptides displayed on the LamB or FhuA fusion proteins were detected using purified human IgG as the primary antibody at a dilution of approximately 1:3,000 to 1:5,000, and HRP-coupled goat anti-human IgG at a dilution of 1:50,000 as secondary antibody. Detection was performed using the Immobilon HRP substrate (Millipore, U.S.). Alternatively, rabbit anti-FhuA or rabbit anti-LamB polyclonal immune sera were used as primary antibodies in combination with HRP-coupled donkey anti-rabbit to verify expression of scaffold proteins for all clones.

Peptide ELISA.

Biotin-labeled peptides (at the N-terminus) were resuspended in DMSO to ~2 mg/ml concentration, divided into smaller aliquots and stored at −20° C. (for short term storage) or −80° C. (long term storage). Streptavidin-coated microtiter ELISA plates (Nunc, 436014) were washed three times with PBS containing 0.2% Tween-20 detergent (PBST). The peptides were diluted in PBS at concentration 5 μg/ml and used for coating the plates at 4° C. overnight. The streptavidin/peptide-coated plates were blocked with PBS supplemented with 2% BSA for 1 hr at RT and then washed with PBST three times. Sera were diluted 1,000× in PBS supplemented with 1% BSA and incubated with the peptides on the plates for 1 hr at room temperature. The bound antibodies were detected with highly specific Horse Radish Peroxidase (HRP)-conjugated anti-human IgG secondary antibodies (Pierce, 31412) used at 2,000× dilution. Antigen-antibody complexes were quantified by measuring the conversion of the substrate ABTS (Sigma, A3219) to colored product based on OD405 nm readings by automatic ELISA reader (Synergy™2, Biotek).

Results

For surface display libraries representing the genome of the nontypeable *Haemophilus influenzae* strain 86-028NP, six screens were performed, using two bacterial surface display libraries in LamB and FhuA and three human IgG pools (Table 1).

For both libraries and in all 6 screenings, screening with biotinylated human IgG produced between 2 and 13-fold more binding clones (relative to input), than did screening without human IgG (Table 1, "specific enrichment"). Thus, the clones selected with the biotinylated human IgG were enriched for NTHi sequences recognized by IgG purified from the immune serum pools.

For each screen, approximately 800 clones were randomly selected and the sequences of the displayed NTHi peptides deduced by DNA sequencing. For NTHi ORFs that were selected more than three times per screen, library clones tested in Western blot analysis using the corresponding IgG pool as used for screening (Table 2). As expected based on the specific enrichment observed during screening (Table 1), a high percent and in most cases the majority of the selected clones were positive in Western blotting with human sera (Table 2).

Following DNA sequence and Western analysis, lead candidate antigens were selected, for which overlapping synthetic peptides were designed. The reactivity of human sera against the peptides was examined by ELISA (an example is given in Table 3).

Multiple peptides from individual antigens from nontypeable *H. influenzae* strain 86-028NP were recognized by human sera (an example is given in Table 3). In case of multiple overlapping peptides belonging to the same antigen (e.g. ntHI 1667-04 to 1667-07), sequential linear peptides were recognized with sera from both healthy individuals and OM patients, for which high seroconversion rates were obtained due to an increase in reactivity by the convalescent compared to the acute serum sample. Such pattern of reactivity is suggestive of longer sequential linear epitopes in the region of the peptide overlap (Table 3). The antigenic peptides recognized with the greatest seroconversion rates using the sera obtained from otitis media patients suggested that the antibodies targeting these epitopes played important role in overcoming the infection caused by this pathogen. On the other hand, the antigenic peptides that elicited high antibody titers in healthy population may have been important for overcoming the initial stages of infection (colonization).

Based on the combination of DNA sequence analysis, Western blotting and peptide ELISA, 156 antigens were identified from NTHi strain 86-028NP, that reacted with human sera (Table 4). The identified epitopes/proteins are immunogenic in humans, suggesting that they are expressed by the pathogen during infection and are capable of inducing a strong immune response (Table 4).

Example 5

Determination of the Conservation of the Immunogenic NTHi Proteins in Diverse NTHi Isolates An ideal vaccine should be present in all, or the vast majority of strains of the target organism the vaccine is directed against. In order to examine the conservation of the open reading frames encoding the identified NTHi antigens, PCR was performed on 47 NTHi isolates (Table 5) with primers specific for the gene of interest. The conservation of all 156 identified NTHi antigens (Table 4) was thus tested.
Experimental Procedures
Isolation of Genomic DNA:

*Haemophilus* spp. bacteria from a frozen stab were grown overnight at 37° C. on BHI+ agar (BHI agar supplemented with 10 µg/mL haemin and 3.5 µg/mL NAD). Next day, one well isolated colony was used to inoculate 7 ml BHI+ medium, followed by incubation with shaking at 37° C. for 18 h.

The 7 ml liquid cultures were harvested by centrifugation at 13000×g for 2 min, the supernatant was removed by aspiration, and bacterial pellets lysed in 600 µl of Lysis Solution (Wizard Genomic Purification kit, Promega). Bacterial genomic DNA was purified according to the manufacturer's instructions (Wizard Genomic Purification kit, Promega).

The bacterial genomic DNA was dissolved in 60 µl of sterile bi-distilled water. The quality of the isolated genomic DNA was examined by 1% agarose gel electrophoresis and ethidium bromide (EtBr) staining, and the genomic DNA was stored at −80° C.
PCR:

PCR was performed with primers specific for the genes of interest. DNA oligonucleotide primers were designed using the public domain program Primer3 (http://frodo.wi.mit.edu/cgi-bin/primer3/primer3_www_slow.cgi), or picked by hand. The fragment size was set to 1,000 bp, and regions identified as antigenic were incorporated in the amplified fragment. In cases where the ORF was smaller than 1,000 bp, the entire ORF was used for the analysis. The PCR primers are listed in Table 7.

PCR was performed in 25 µl reaction volumes, using Taq polymerase (1 U, Solis Biodyne, Estonia), 200 µM dNTPs (Fermentas, Germany), 2 mM $MgCl_2$ (Solis Biodyne, Estonia), 0.4 µMol of each oligonucleotide (MWG, Germany) and 10-20 ng of genomic DNA.

The cycling conditions were:
Heat denature 95° C., 5 min.
30-35 cycles of (95° C. 30 s, anneal 30 s, 72° C. 1 min 20 s)
72° C. 10 min
Soak 4° C.

The annealing temperature was adjusted for primers as required, but was generally 56° C. The PCR reactions were electrophoresed on 1.0% agarose TAE gels, together with 100 bp ladder (Invitrogen, 15628-050, 1 µg/ml). Gels were stained with EtBr and photographed on a standard UV table using an Olympus SP-500 UZ camera, appropriate filters, and AlphaEase FC software (v 5.0.1, Alpha Innotech Corporation).

To avoid false-positive results, negative control PCR reactions with water as template were included in all runs.

To avoid false-negative results, the library isolate NTHi 86-028NP was included in all PCR runs, to serve as positive control. In addition, all PCR reactions negative in the first amplification round were repeated in a second round, generally under the same conditions. In some cases, a third round was done applying changed cycling conditions and a proof-reading thermostable DNA polymerase.

For each ORF, the number of isolates, where the ORF could be detected by PCR was first determined, based on the PCR analysis strategy described above. This number was termed "N". The level of conservation can be calculated for each ORF as: N/47. N is stated in Table 6.
Results An example of the PCR analysis is given in FIG. 3A. The antigenic open reading frame NTHI1323 was conserved in 43 out of 47 examined NTHi isolates (FIG. 3A and Table 6). The antigenic open reading frame NTHI1983 was conserved in 8 out of 47 examined NTHi isolates (FIG. 3A and Table 6).

For the 156 ORFs encoding antigenic NTHi proteins (Table 4), it was found that the majority of ORFs were conserved amongst a set of 47 reference NTHi isolates comprising worldwide geographical locations (Table 5, Table 6 and FIG. 3). For example, 80 antigenic ORFs were conserved in all 47 NTHi isolates (Table 6 and FIG. 3), and the majority or 80% of the 156 examined ORFs were conserved in more than 90% of the 47 examined NTHi isolates (FIG. 3).

Thus, the identified antigenic NTHi proteins (Table 4) were generally highly conserved (Table 6 and FIG. 3), supporting their use as vaccine antigen.

Example 6

Testing Protectivity of NTHi Antigen-Induced Immune Response Against NTHi Infection Study Rationale:

Although NTHI is a human pathogen, several animal models have been developed in order to study protective potential of candidate antigens against NTHI infection and colonization. Pulmonary clearance models involve the direct inoculation or aerosolization of bacteria into the lungs of experimental animals, including rats and mice. The rate at which the bacteria are cleared from the lungs is measured following pulmonary challenge by live bacteria. Pulmonary clearance models are being used to evaluate potential vaccine antigens of both *H. influenzae* and *M. catarrhalis* (Murphy 2005). Groups of animals are immunized with a putative vaccine antigen and an appropriate adjuvant. The enhancement of clearance by immunization with a putative vaccine antigen compared with controls is interpreted as a positive result, suggesting that the antigen may have a protective effect. The observation that an antigen induces enhanced pulmonary clearance in such animal model represents a line of evidence that the antigen may induce protection in humans.

The protective potential of NTHI protein antigens was studied in a mouse pulmonary clearance model. The highly conserved NTHI proteins that were selected during the library screening using human sera were expressed and purified as recombinant proteins and used for immunization of mice, in order to induce a hyperimmune response and evaluate the rate of bacterial clearance following the challenge.

Experimental Procedures

Cloning and Expression of Recombinant NTHi Proteins

Cloning of Genes/DNA Fragments:

The gene/DNA fragment of interest was amplified from genomic DNA of *Haemophilus influenzae* strain 86-028NP by PCR using gene specific primers. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. The constructs are listed in Table 8. Once the recombinant plasmid was confirmed to contain the gene of interest, *E. coli* BL21-CodonPlus (DE3)-RIPL cells (Stratagene) serving as expression host were transformed.

Expression and Purification of Proteins:

*E. coli* BL21-CodonPlus (DE3)-RIPL cells harboring the recombinant plasmid were grown into log phase in the required culture volume. Once an $OD_{600nm}$ of 0.6 was reached the culture was induced with 0.1 mM IPTG for 3 hours at 37° C. The cells were harvested by centrifugation, lysed by a combination of the freeze-thaw method followed by disruption of cells with High pressure Homogenizer Panda 2K, (Niro Soavi). The lysate was separated by centrifugation into soluble (supernatant) and insoluble (pellet) fractions. Depending on the location of the protein different purification strategies were applied. A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6xHIS) at the C- or N-terminus of the expressed protein, it bound to the Ni-Sepharose while the other contaminating proteins were washed from the column by wash buffer. The protein was eluted by 250 mM Imidazole in 50 mM Tris, 150 mM NaCl buffer at pH 8.0. The eluate was dialyzed against 50 mM Tris, 150 mM NaCl buffer at pH 8.0 and concentrated if necessary. The protein concentration was assayed by Bradford or BCA and the protein quality and integrity was checked by SDS-PAGE and Western blot. B) If the protein was present in the insoluble fraction, the pellet was washed several times to purify inclusion bodies. Inclusion bodies were solubilized in suitable buffer containing 8 M Urea and applied onto the Ni-NTA column under denaturing conditions (in buffer containing 8 M Urea) using the same materials and procedure as mentioned above. Contaminating proteins were washed from the column under denaturing conditions. Refolding of the His-tagged protein was performed while the protein was immobilized on the Ni-NTA matrix using buffer without urea. After renaturation, proteins were eluted by the addition of 250 mM Imidazole. The eluate was dialyzed to remove traces of urea and concentrated if the volume was large, checked by SDS-PAGE and measured by the Bradford or BCA method. Alternative, dilution refolding of the His-tagged protein was performed after the protein was eluted under denaturing conditions from the Ni-Sepharose beads by diluting the protein in an appropriate buffer without urea but containing e.g. surfactants. After renaturation, proteins were concentrated, checked by SDS-PAGE and protein concentration measured.

Mouse Pulmonary Clearance Study:

Proteins were emulsified in a 1:1 ratio with Incomplete Freund's adjuvant. Killed bacteria (WKC) were used as a positive control, whereas the negative control was the adjuvant vehicle injected alone. Both control groups were formulated and delivered in the same manner as the tested antigens. *Haemophilus* protein D, which was shown to be protective in several published studies (Schuerman et al., 2009; Novotny et al., 2006) was tested in parallel for the sake of comparison to our candidate antigens. Three immunizations were delivered at weekly intervals (days 0, 7 and 14), with the following protocol timelines:

On Days 0, 7 and 14:
  the mice received an intraperitoneal injection (i.p.) of 50 µg of protein emulsified in Incomplete Freund's adjuvant.

On Day 21:

0 h Bacterial Challenge:
  live bolus challenge with live nontypeable *Haemophilus influenzae* strain 86-028NP (Harrison et al., 2005). Bacteria were grown overnight on Chocolate agar, harvested and washed three times in PBS. The concentration was assessed by measurement of optical density at 405 nm and adjusted to a challenge dosage of $10^6$ CFU in 20 µl [$5 \times 10^7$ CFU/ml]. Mice were sedated by intravenous (tail vein) injection of 0.12-0.15 ml (20 mg alphadone in PBS/kg body weight). The trachea was visualised through the oral cavity, a 22.5 G catheter is inserted and a 20 µl volume of PBS containing the live bacteria is introduced into the lungs with two 0.3 ml volumes of air.

0-6 h Observations on Clinical Status of Mice 6 h Autopsy and Collection of Tissues for Bacteria and White Cell Counts in the Lung:
  at 6 h post-challenge, mice were euthanized by anesthetic overdose. Blood was collected by heart puncture, allowed to clot and serum collected following centrifugation at 4° C., 450×g, 10 min. Serum is stored at −80° C.
  the lungs were lavaged with 0.5 ml PBS (Bronchoalveolar lavage—BAL). Following lavage, the lungs were excised, connective tissue and heart are removed, placed in PBS and homogenised. BAL and lung homogenate were assessed for bacterial counts by plating, on chocolate agar plates, duplicate 20 μl volumes of a 10-fold series titration. Colonies were counted next day and calculated.

Results:

Several vaccine antigen candidates have induced immune response which provided significantly faster clearance of the bacteria compared to PBS (adjuvant vehicle) control.

The percentage of the bacteria (colony forming units, CFU) recovered in bronchoalveolar lavage calculated in reference to adjuvant control in phosphate based saline (PBS) is shown on FIG. 4A. The median % value of the bacteria recovered after challenge from the animals immunized with killed whole cells (WKC) was 45%, and from the animals immunized with the protein D, it was ~60% compared to adjuvant vehicle (PBS). Candidate antigens NTHI0371-1, NTHI0830-1, NTHI1169-2, NTHI1390-1, NTHI0782-1 and NTHI0370-1 provided faster clearance compared to both, killed whole cells and protein D, whereas the other candidates induced a comparable or up to 40% higher clearance compared to killed whole cells.

FIG. 4B shows the bacterial recovery from the lung tissue collected from the mice 6 h after challenge with NTHI. In the lung homogenates from the animals immunized with whole killed cells, the bacterial recovery compared to adjuvant control was 50%, and in the animals immunized with the protein D there was ~75% bacterial recovery, suggesting only a modest acceleration of clearance compared to adjuvant (PBS). However, from the lungs of the animals immunized with the NTHI antigens NTHI0716-1, NTHI0830-1, NTHI1390-1, NTHI0782-1, NTHI0370-1 and NTHI0525, between 10% and 40% of bacteria were recovered; therefore there was >60% increase in clearance compared to adjuvant control and 10%-50% faster clearance compared to positive controls (whole cell and protein D).

FIG. 4C shows a total % of recovered bacteria compared to adjuvant control group (PBS) when the results from both FIG. 4A (recovery in bronchoalveolar lavage) and FIG. 4B (recovery from lung tissue homogenate) were combined. Several NTHI antigens still show a faster clearance of the bacteria compared to both, negative (adjuvant/PBS) and positive (whole cells, protein D) controls.

Therefore, the described in vivo studies support the further use of selected antigens for testing and development of the vaccine against otitis media.

REFERENCES

The following references which have been recited in the present specification in a truncated version are incorporated herein by reference in their entirety.

Altschul, S., et al. (1990). *Journal of Molecular Biology* 215: 403-10.
Amit, A. G., et al. (1986). *Science* 233: 747-753.
Bennett, D., et al. (1995). *J Mol Recognit* 8: 52-8.
Carter, P., et al. (1985). *Nucl. Acids Res.* 13: 4431-4443.
Clackson, T., et al. (1991). *Nature* 352: 624-8.
Cohen, J. (1993). *Science* 259: 1691-1692.
Cripps, A. W. and Otczyk, D. C. (2006). *Expert Rev Vaccines* 5: 517-34.
Current Protocols in Molecular Biology, John Wiley and Sons, Inc. (1987).
Devereux, J., et al. (1984). *Nucleic acids research* 12: 387-95.
Doherty, E., et al. (2001). *Annu Rev Biophys Biomol Struct* 30: 457-475.
Eisenbraun, M., et al. (1993). *DNA Cell Biol* 12: 791-7.
Etz, H., et al. (2001). *J Bacteriol* 183: 6924-35.
Foxwell, A. R., et al. (1998). *Microbiol Mol Biol Rev.* 62: 294-308.
Ganz, T. (1999). *Science* 286: 420-421.
Georgiou, G. (1997). *Nature Biotechnology* 15: 29-34.
Harrison, A., et al. (2005). *J. Bacteriol.* 187: 4627-36.
Hemmer, B., et al. (1999). *Nat Med* 5: 1375-82.
Hogg, J. S., et al. (2007). *Genome Biol.* 8: R103.
Hornef, M., et al. (2002). *Nat Immunol* 3: 1033-40.
Huse, W. D., et al. (1988). *Science* 246: 1275-1281.
Ishibashi, S., et al. (1993). *J. Clin. Invest.* 92: 883-893.
Johanson, K., et al. (1995). *J Biol Chem* 270: 9459-71.
Jones, P., et al. (1986). *Nature* 321: 522-5.
Kajava, A., et al. (2000). *J Bacteriol* 182: 2163-9.
Kay, M., et al. (1994). *Proc. Natl. Acad. Sci. USA* 91: 2353-2357.
Köhler, G., et al. (1975). *Nature* 256: 495-7.
Kolaskar, A. S., and Tongaonkar, P. C. (1990). *FEBS Lett* 276: 172-4.
Lewin, A., et al. (2001). *Trends Mol Med* 7: 221-8.
Marcy, S. M., (2004). *Cleve Clin J. Med.* 71: S3-9.
Marks, J., et al. (1992). *Biotechnology* (N Y) 10: 779-83.
McCafferty, J., et al. (1990). *Nature* 348: 552-4.
Murphy, T. F. (2005). *Expert Rev Vaccines* 4: 843-53.
Nagy, E., et al. (2003). Identification of the "antigenome"—a novel tool for design and development of subunit vaccines against bacterial pathogens. In Genomics, Proteomics and Vaccines (G. Grandi, ed), John Wiley & Sons Ltd., UK.
Novotny, L. A., et al. (2006). Passive immunization with human anti-protein D antibodies induced by polysaccharide protein D conjugates protects chinchillas against otitis media after intranasal challenge with *Haemophilus influenzae*. Vaccine 24(22): 4804-11.
Okano, H., et al. (1991). *J Neurochem* 56: 560-7.
Queen, C., et al. (1989). *Proc. Natl. Acad. Sci. USA* 86: 10029-10033.
Rammensee, H., et al. (1999). *Immunogenetics* 50: 213-9.
Rao, V. K., et al. (1999). *FEMS Microbiol Rev.* 23: 99-129.
Remington's Pharmaceutical Sciences, by E. W. Martin, Mack Publishing Co., Easton, Pa., 15th Edition (1975).
Riechmann, L., et al. (1988). *Nature* 332: 323-327.
Seeger, C., et al. (1984). *Proc Natl Acad Sci USA* 81: 5849-52.
Schuerman, L., et al. (2009). Prevention of otitis media: now a reality? *Vaccine* 27(42): 5748-54.
Skerra, A. (1994). *Gene* 151: 131-5.
Tang, D., et al. (1992). *Nature* 356: 152-4.
Tempest, P., et al. (1991). *Biotechnology* (N Y) 9: 266-71.
Tourdot, S., et al. (2000). *Eur J Immunol* 30: 3411-21.
von Heinje, G. (1987). Sequence Analysis in Molecular Biology, Academic Press.
Wang, P., et al. (2008). *PLoS Comput Biol* 4:e1000048.
Wells, J. A., et al. (1985). *Gene* 34: 315-323.
Wells, J. A., et al. (1986). *Philos. Trans. R. Soc. London Ser. A* 317: 415.
Zhang, Q., et al. (2008). *Nucleic Acids Res.* 1; 36 (Web Server issue):W513-8. Epub 2008 May 31.
Zoller, M. J., et al. (1987). *Nucl. Acids Res.* 10: 6487-6500.

The features of the present invention disclosed in the specification, the claims and/or the drawings may both separately and in any combination thereof be material for realizing the invention in various forms thereof.

SEQUENCE LISTING (669 sequences)

SEQ ID NO: 1 - DNA, 3087 bp, Haemophilus influenzae
atgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagaattttggaaaaattttggtgagtcaaatgatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatggacgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataa

SEQ ID NO: 2 - DNA, 1956 bp, Haemophilus influenzae
atgaatttaaaaaaatttttcaatacgccaactcatgagccgttccgcgataaaaaagcggagcgtaacctttttgcacgccgaacgttagtggcttttttggggattttgctactaacaggtgttttattcaccaatatttatcagctacagattgttaatttcgatacttaccgaacgcgttctaatggtaaccgaattaaattattacctttaccgccaacgcgtggcttaatctatgatcgttacggtaaattattagccgaaaatcttactttttttggtttatacattgtgccggaaaaaactgaaaatttagaccgcactttagatgaattacgctacattgtgggattgacggataacgatattgaacattttaaaaaagaacgtctccgcggaacgcgttatacaccgattttattaaagccgaatttaacagaagaacaaatttcacgctttgcggtaaatggctaccaatacccgagtttagaggtacgtccttatttcaaacgccattatttatatggcgaaacaatggcgcatattttgggctatgtaggtaaaatgaatgataaagatgtagaacgtttgaaacgagaggataaatttgcgaattatgcggggacgaacgatattggaaaattgggtattgaacgttattacgaggatatactgcaaggtaccacgggttttgaagaagtagaaattaataatcgcggcaaagtaatccgtactttgcgtagccgacctgctgtggcgggaaaaagtattcatttaactattgatttagcattacagcgttatattactgaacttttatcgggactaaaaggtgctgtagttgtgcttgatcctaaagatagtagtgtattagcgatggtatctacaccaagttatgacaataatttatttgttgatggtatttcctccgaagattataaacgtttattaaatgatcctgctcgtccgctttatagtcgtgcgacacaaggtgcgtatccgcccgcttcaacagtcaaaccttttattgcagtagccgcacaaactgaaaatgtgattacaccaaacacaacgatttttgatccgggatattgggtattacctaactccacaaaacgttttcgtgattggaaaaaaacaggccacggagatacggatttgaataaagcgattactgaatcctctgatacttatttttatcaagtggcttataatatgggtattgatcgtctttctaattggatgaaggattttggttttggtatgccaacggggattgaaattcaagaagaaacggctgccaatatgccaactcgagaatggaaacaaaaacgctataaacgcccttgggtacaaggcgatacgatttcggttgggattggtcaaggttattggacggcaacaccactacaagtagcaaaagcaacgacgatattggtcaataatggcaaagtaaatacgccgcatttgatgaaagcaattgagggggcagttctagagccttatgaagatccgttaatttatcctgatattagtacacctaaagtgacggcttgggaggcagcgaaacgcggtatgtacaatgttgttaatgctgcaaatggaactgggcgaaaagcctttgcagatgccaattatcgtgttgcaggaaaatctggtactgctcaagtgtttagtttaaaagaaaatgaaaaatacaatgcggtgggattgaaaaaagaattgcatgatcacgcatggtttaccgcatatgcgccttatgaaaaccctagattggttgtgacagtgattttagaaaatgcaggtggtggttcaagtaatgccgcaccgttagcgcgtaaagtgatggattactatttaaatcagcgtttaccacaagttgaaaaatataatgtacctattcagcaaaaaaaagatttgtcacaagagagcgaacaaataaatggaagataa

SEQ ID NO: 3 - DNA, 1299 bp, Haemophilus influenzae
atgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataa

SEQ ID NO: 4 - DNA, 1677 bp, Haemophilus influenzae
atgcttactcaacttactatcaataattttgcgattgttcgtcagcttgatattgaattggcgaaaggaatgtctgttataacaggggaaactggtgctggaaaatctatcgccattgatgctttaggtttatgtttcggacaaagagtagaaacctcaatggtgcgtgaagggcaagagcgtgcggaaatttgtgcaactttccaactagaatcgcaaaatcctgcttatcactggttgagtgagcaagaattacaggatccagataatccaactgaatgtattttacgtcgtataattaatgcagacggacgttctaaggcttttattaatagtacaccagtatccgcttctcaattaaaagaaattgctcaatatctcgttcatattaatgggcaacacgcttctcaattattgttaaaaaatgactatcagcttcagttagttgataattttgccgctcatcctgaattacttgtgaaaatgcgtgaagattatcagacatggaaaaatcttcaaaatcaagttaaaacctttcaacaaaaagtggcggaaaatgaagcacgtaaacaacttttacagtatcaagtggatgagttagatgaatttaaccttcgaccaaatgaatatttggaattagaagatgaacaacgtcgtttatctagcagcgaacagctaacccaactttctcaatcggccctgcaaattttaagtgaaaatgacaccgtaaatatcgatagtttgctttatcgtgcgacacaatatattgatgaattagctgaacttgatccgcaatatgctgaagtgcaaaatatgttgaatgatgcgttgattcaagtgcaagaagcaaccagtgaagtgcaaaatttatcaagtaatatcgagcaggatcctcaacttttacaggaaatcgaacagcgaattagtcaggctttacaacttgctcgtaaacatcaagttaaacctgaagatcttgtagaacagcacaaaaaattaaaagcggaattaaccgcacttttggatttttctgaaagtgaagagatgttgattgagcaagaaaaacgagcatttgaacaaatgcaagcaacggctacagcattaacagcaagtcgtcagcaatctgcaacccgcttagcgcaaaatgtcacacagtcgataaaacaacttgcaatggaaaacgctgaattttatgtagagttgaatacggatttagataaagtgagtgcaaatggtgcggataatgtgattttcactttgcgtagtaatttaggacaacaaccgcagccattagctaaaattgcctctggtggtgagctttctcgtatttctttagcgattcaagttttaacttctgatcaatcggctattccaacgttaattttcgatgaagtggacgtgggcattagcggaaaaacagcaagtgttgtcggaaaacttttacgtcaattaagtgaacgctgccaagtattatgcgtaacgcacttgccacaggttgcttgtcatggccatcatcagttcaatgtagaaaaatttactgttgataataaaactgaaacaaaaatgaccgcactttcacaagctgaacgtgtaccagccttggcaagactcttgggcggaagtgaaatcacagaattagctctagccaatgcacaggaaatgttagatttggttcattaa

SEQ ID NO: 5 - DNA, 2124 bp, Haemophilus influenzae
atgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggactcggaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccaaaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttga

SEQ ID NO: 6 - DNA, 687 bp, Haemophilus influenzae
atggcagaacaacaagtcaaaaaaaagaaaaagggtcttttttactacattaatgcggtattagccgccttattgggttccctgattttgagcattattcttgaatggttaggtattgcatttttatggcctgaagaaggtcatttacacagtcaaaaaatgatgctaactgagcttggatggctttctgatagtctaacgagaggtcttttctatcattctccaaaagagctggctgaaggtcttattttgtcattacatgaatggctttttgtgaaaacaggtgtaaaagattggttagccaaccctcgtgagcatagtggcgtaggtttgtgggtgtatcattatgggcgagcgtatattgagtcagtgatttatgtttttatcacctttgttattcgacttgtagtgattgtttttacttccccactctttttgttagccgcatttgcgggctttactgaagggttaatgatgcgtgaccgtcgtaaatttggtgcgggcagagagtctagttttctttatcatcatgcacgtcgattaattggcccgattatgttgtcggcatgggtattgtatctttctatcccaatttctatttacccgaatataattttggtgccagctgcatttctatttggactatccatctgtgtaacggcagcgagctttaaaaaatacctttaa

SEQ ID NO: 7 - DNA, 351 bp, Haemophilus influenzae
ttggaatctgtttcaagtaaggagttctccgtgactaaaaatattttcagtttatctctagcaatagggttattgtttggcgctataagtgctcaagcaacagagcaagagcatttagcgcaagcaattaaacagttggatgcagcaaaactctcattacagcgagcagctgcaagtgcaaaggtttctgcgaaaagtcgtgaatattttgattacgcttcagcacatcaagatattgctacggtacaggcagggattaagcaatatattaacccttcccgggcaatccctagaaatcctaaagctattcgtaacttaaaagaagattatctcaatcttcggagtcaatag

SEQ ID NO: 8 - DNA, 402 bp, Haemophilus influenzae
atgaagttgattaaatccttctttcagaatgtttcaagtcgttttcttgcggtagtaactttactttggttatccgttgaaaatgcgtttgctacaggcggtggtaatggtatcaatgcctctaaaatccctgattttaaaatcccaggcgtagatagcaataccaaagacccgatggaaatcatctatcttgttgctaaatcattggcaaccttgtgtgcaattttatttgcagcatggtcaatcatgacagtggttaaggcattaattaaaacctataacgcagcgactgacgaaaatgacaaaaaaggatggggcccatttattatcgctcttattcttggtttcattttaattttcttcagcctctggttggtgaaattggctatcggtctgttttaa

SEQ ID NO: 9 - DNA, 645 bp, Haemophilus influenzae
atgagtaacttaaaagggattgttcatcaaaaaaatcgcgaaatcatgaccgggcgaattgctatcggtgcattgcttgtgatttgtttggtgctatgtgccattatttttaccgcaccaagtcgattaatgatttataacccaccggatttacgtgcgggaagtcaacgcccttggtgggaagtgccaaaatcaaccgtttatgcctttgcttatcaaaccttccagcagttaaaccgctggatggagaatggcgaggaagaatacaaattaaatattgaaagaaataaagcctttattacgccaagttgccaagaatttttgaagaaagactactatgaccgtttatctaacggtgaattacgtgaacgtgcacgtggtgtttatgaaattgtgggacgtggatttaaagacagtagcgttattgtgcatagtccagatagctggacggttaatcttgatttaagtgtagatgagtatttcaaagatgaaccagtaaaacgtgttttaacccgcttcccggtcaatatcgtgcgcatggaaacagatttacagaacaatccttggggattgggatttaactgctacagctcaattccattacgtttagaagcaaaagaatttagagaaggggataaccaataa

SEQ ID NO: 10 - DNA, 870 bp, Haemophilus influenzae
atgaaaaaactcactttgttactaagcgcggcttttatcttttcaccaatgacggcatctgccgatgtgttaatgaaatgggcgcgcaaaccgttacctattgacttacaaatcgaaaaagaacgtattctattcgtagataaaaatgtaaaagtaggttatccacctgaattagatagcaagcttcgcattcaatcaactggcggtgcggtttatttaaaagcaactgcagatttcccaaaaacacgcttgcagcttatggatgttgcaactggagaaataatcttacttgatgtgcaagcgaagcattctgttgccaatgcaagtgagccaattcgctttgtttatgaaaataaagttgaaaaacaaacaactgcttatggccaagatgcaaatgcatataacgaaccaatgccaaatgcgcgtccggcactccccgctccagctgcattaacacgttatgccgcacaaatgttttatgcgcctttacgttcagttgagcctttggaaggtgtgcgccaagtttcacatcgccttcctacaccgcttaaaacgctcttacctgcattgcctgtgcgagctactccattactcagctggcaacttgatgagtatgttgtcactgcggttcgcttgcaaaaccaggggcaatctcgcattgatttagatcctcgagagcttcaaggtcgattctatgcagcaacatttcagcataattggcttggggggcatgatacacctgaagataccacaacgttatatcttgtgacagaaggttcacctaatcattctgttatccctcagtcaaattcatataaaccgaaaaaattgaaaaaagtcaccacaacagtgacaactcaaacaaaataa

SEQ ID NO: 11 - DNA, 1401 bp, Haemophilus influenzae
atgcaaatgaaagcaaataaagcgttctatgttattggtgggattaccgctcttgtcgtgacgctgatggctggatttcttttctccggtagtagttcaacaaatacagcagaaaccaagaaagaagatactttagatatctcttttaaagatttatcaccggaagaattacgagcaatggggattgagggtgacacatctaaagatacggtaagaacacttataggtaaagtgaaagagcataataagcgatttgatgaagtgattttacaaaatgaacgcttggtaaaagagaatgagcagttaaaaaatcaagcaaacaatacggattatcaaattcaacaggcggtacaagcagaaacaggggcgttaattaatgagattaatgcgttaaaagatcaggttgtacaagctggtaatcaagttgtagggaatggaaatgcccaggcaaatcccaatgctcctctaccaataaacggagcaacaactggccctcaggttgaaactcgagggggaattaattgggtgaaccctagtgatatgccaactacagacagacaagggaatgctctacaaggtattggtgtaaatggtgcaggaatcggttttcccaaaaccttcgataacaatgtgaatgacatccgaaaatctaatgatgggttgcaatctagtacaggtaataatgcaatatttaataccgctacaccatttttcacaattgcagctaactctactttaactaattctgttgctatgactgcgcttgttgggcgtgtgccgattgacaataaggtaaccgagccttatccgtttaaattgcttattggtcgagataacttaattgcaaatggcattgaactgccggatattgaaggcgcaattgtctctggaacagcaagcggtgactggacgctatcttgtgttcgtggtgatgtgaaaagcttaacttttgtgtttagcgatggccgcattgtttcaacagacaattctgacgataaaattggctggttatctgatccacatggtgtgccttgcattcctggagaacgcagaacaaatgctccggaatatctaacgaccaacttcttcttaacgggggcttcagcagctgcacaaggcttatcatcttctcaatcaacaacagtggttgatggcggtgcagtaattggtgcggtaacgggtaataacggtaagtatattcttggtcaagcgttaggtggcggtttgagagaaacagcagactggttccgtcagcgttatggccaaatgtttgatgcggtatatgttccaccgggtaaagaagtggctgtacacatcgaaaaacaaattgatattgattatgaccgcatgtctcgaaaagtgaaatacggacaagcctcaagacaatctaacttggattaa

SEQ ID NO: 12 - DNA, 2871 bp, Haemophilus influenzae
atggcattattccaagacgtgttagaggctttcttccctgctaaaaaaggtgataagcctcaacctaaaaaggaacctatcctaacatccattgcaccggaagaagcacagcaggatgataccaataacgtagaagagacgattgaaatcactcctgttatgcgtaatagaaaaatgaccagagagcaacatgttaaaatgctttatgggcgcgatccctcttttatctccaatcttccttatgcggaatatttggaagaagaaggcgtaatgctttttgatgatgctaaaagtgcaggtgcggtatttgatattaagcctataggaactgagggaagaagcagcgactatcttaatcgcgttcgcacattggttaaagatgccttacaggatagtttcgatgaacttgataccaacccttacgttgtacaattctattgccaggatgacaaggatttaagcggttatgttgagaatctgagacagtacattaaaaccacttcacctgaagcgagcggtagtgagtttacagaacagtggcttggtgaaatggagcgtcacttaaaagcagtaggtaaaccaggtgggctttttgttgatgaccgggtaacaaatacggcatgggctggaaaagtgcgtaaaacacgcatggttatttatcgttatgctggaaataatgagacagatacaatcgagaaattaaatacagcttgtgatcgtgttcaaagtgcttttatcacagctggattaaccatggaacgccaaaatgaaacacaaattcatcgttggttattagaatggtttaatccaaatccatcacgctattttaacggactcgatgataaagcttgctatgatcttttatcactctctaaggatgaatctgctctaccattacaagaccaagattttagtgaaaatctcttttttacgccaccggaaagtaaaaatggctattggtattttaatgagcaacctcacgaagtcattgtagttgataatattcgtaagcagccggatgttggccacatgacaggcgaagtcactcgaggtcgtaatattaatgcactatttgatttattgccggaatcaaccattatggctatcactgtagtcattcatcctcaagataaattacaggcgcatttagacaaattaagtagtcgagctgtcggtaataactatgagtctatctatttaaaacaagatgccctcacagtaacggaatatttaaaagacggacacaagctttatcaagctggcatggttttctatgtaagagggaaagacgatcaagagctacgcattcgctcaagagaattaagaacggttttactcagtaataatttagtgccggtaaaagaaggcaacgaagttgcgcctcttaatagctatttacgctggctaccgatgaattttaatcctcaattagatgcaaaatctcgtttttataccaaatattattgggtgcaacacattgcgaatatgttacctgtatttggccgtgagaccggaacgggacacccaggaatcacctattttaaccgcggtggaagcccattagattttgacccactaaaccctaaagaccggactaaaaatgcgcataagctcattttaggccctacaggttcaggtaaatcggcaacattaaccgcacaaatggcacaactgatggcggtgcaccgtcctcgcttgtttattgtagaagcaggtaactcttttggattgttttcagattatgcggagcgttacggtttaacggttaaccgggtatctcttgagccaagtagtaacatcgctttaccgctcttctctgaagcgcatcgtttattggaaatggatatcgatcttgaagttcaagatgatgacgataatgaagatgaaggcgaggaacaacgagacttacttgcggaaatggaattaaccgctcgcttaatgatcaccgggggagaagcgaaggaagatgagaaaatgagccgtgctgaccgctcggctattcgccaggctattttattagctgcagagaaaacttcacaagagaccccacctcgtcaagttttaaccggggatgtaaaagccgcacttgaggagttaagtcgtcgccaagatattcgcccggaacgtgcatctcgtcttgcagatatggccgaagcaatggatattttctgcactggggtaaatggtcgattctttaaccgtgaaggggaaatttggcctgaagctgatattacacttgtcgatttggcgatgtttgcacgtgatggctatgaagctgaattagcgatttcgtatatttccctaattaaccatatcaactcattaggtgaaaaatatcaacacagtttccgccctatcgtgaacattacggatgagtcgcatatcattaccgtaaatccacttctagctaagttcctggttaaaggttctaaaatgtggcgtaaattgggtatttggttatggttagctacacagaatatggctgacttccctgatgaatctgataaattactcagcatggttgaatggtgggaattacttaacctttctaatgatgaagtcgaacaggtaaaccgtttccgtcgtttatccgaagctcagaaaatgatgttgttatctgcgaaaaaagcagataagaaatatactgaaggtgtggtgctcgcaaccaatatggaagccttattccgtgttgttccacctagtctttacttagcactagggatgactgaaaaacacgagaaagcacaacgtaaacaattaatgatggaacataactgtactgagttagatgcggcattgatggttgctaaagacttagacaaaaaacgggggattgcagtcaatgacgaacttaactcaatcgcagcctaa

SEQ ID NO: 13 - DNA, 2001 bp, Haemophilus influenzae
atgaaattaaatcatgcactgaaagcatcttatattgctatatcgtgcgcaatcttatcctcaaccatgccagtatcagcttctaatagtaatccgtttggatttaataaagccgattctattttgtctgatatggtgttttatcaaattgggggcggtgtaggttatatggctcccccgagtcgaggtacgattcctgcagctgaatttgggattggttggaaagctaacttgatgtgcggtaattttgacattaagacgagtattaaaaatcagttaaatggtttaactgaaggatttaaagatctttatagtaacgttatcgaatcagccacaggagctgtggcgagtttacctgcaatggttattcaacgagcaaatcctcagttatacgatattcttacgaatggtttatatcaaggtaaaattgattttaatagcttaaaaaccagctgtgaagaaatgtctaagaagcttgcagacgcaactttaaatggtcgttggtctcaaagttcggatatggaatcctttaaagacattacttcaactgaaccagatgctactcgagctaaaaagagacttgaggaatctcaaggtaaggaaggtaaagagtgggtcgggggtaaaaaacgcggtggccaaggacaagaaccaatcaaaattgttgaggatgttgcaaaagctggctacaacatgcaaaacaagcgtaatgtattagaatcaggtcgaatctccggtagtagttgtagcggattactttgtcaaacttgggataatcctaaagatatgacagattggttaacgaatgtgatcggtgagaagcaattaactacttgtaaaacagattgtggtactgctagtagctctcgagctggtgttggtttaacacctgaaattgaaaaagaaaatattaagacggtaactcaattacaaaaagcgcttaacatgagcactccttccgttgaagtacttgcagaattaagttctacaacagttcctgtaactcgtggcttaattgagtctttacgagaagatcccgatgctcaagtattagggcagcgtttagccagtgaaattgctgtagctaaaacaatggagaaaatgcttcttgcacgtcgagctgttttaacgggtatgcgtgagccaaatgtggccaacaataaagatgctcaagaagagttagaaaagatcctcactttaattgaccgagaaataggtcaaattagaatggagattgatctacaaaaatcacttaccgggaattccgcagttgcaatcctacaaaataaagagctacgtgaatataacactggaaccggaaatgttacacgtgacagtgtagataaacggattagcgatttagctaatggtacgaatagcaatgctgctgaattggcagatgctgacaatatcaatattcctcgtaacaatgtcactttagaagtgcctcagatgtcaaactccctgtcttacaccgggactggcggtacatccggaaatagtagaggtaacacttcttattcatcagttccagcaattaaagggactgcacttgatcaagctacagggttgttgaaaaaatttgaagggtttagtgataaagcatattgggatgtcaatgcttatcgcactggatatggttcagatactatcacaaaagcggatggtacaattgtcaaagtaacgaaagatactgtagttagtcgcgctgacgcagagcgtgatttagcacgtcgaacacaagaatttgcaaatagagcgagaaataacgtatcatcttcaacatgggataagttaccgccaaatgcccaagccgcattaacatcttatgcctataactatggctcattaacaaaagatgtgattgctgcagcccaggcatctgcgcaatcaggcgatatgaacgcactagcaaatgcagtaagaaatcgtcaaaacaataataatggtgtaaatgctaaacgtcgtaaccaagaagcagattacattttaggaaaataa

SEQ ID NO: 14 - DNA, 945 bp, Haemophilus influenzae
atgttaagaatttacgctcctgcatctagcgcgaatattagcgtaggtttcgatactttaggtgctgcgatctctcctattgatggttctttgttaggcgatgtggttcaaatagaatctatttcaagtggttttgagttagaaagtgcgggctattttgttcgtaaattaccgaaagaaccacaaaaaaatattgtttaccaagcttatgtgctatttagcgagcaattaaaattacgcggagcaaatgttaaacctttacgtttaacgctcgaaaaaaatatgcctattggctctggtttaggctctagtgcttgttctattgttgctgcattagtggcattaaatcagtttcataatgaacctttttcgaaaatggaattgcttgaaatgatgggagaattggaaggtcgtatttctggttcaatccattatgataacgtcgcaccttgctatcttggcggtgtgcaatttatggtgcaatcgctcggcaatatttgtcaaaaattgccattttttgataattggtattgggtgttagcctatccagggattgaagtttctactgctgaagctcgtgcaattttaccgaaaagctatactcgacaaaacgtgattgcccatggtcgtcatttaggtggctttgtgcatgcttgccatacccatcaggaaaatcttgccgcgattatgatgaaagatgtcattgccgagccttatcgtgaatctctgttacctaattttgctgaagtaaaacaagctactcgagacttaggcgcacttgccacaggtatttcaggctcagggccaactattttctctattgcccctgatttacaaactgcaattaaactttcaagttatttagaaagccattatttacaaaataatgaaggttttgtgcatgtatgtaaagttgataacgaaggcacaagagaaattaaataa

SEQ ID NO: 15 - DNA, 3027 bp, Haemophilus influenzae
atggtttcaggaactaaggaaaaagatttagaaattgccatcgaaaaagccttaactggcacttggcgtgaaaacatggaaaataagctgggcgagccgaaggctgaatacctgccgcgccatcatggttttaaactggcattttcacaggattttgatgcgcagtttgccatcgacacacgtctgttttggcaattcctgcaaaccagccaagaggcagaacttgcccgttttcaacaactcaacccaaacgactggcagcgtaaaattttggagcgattagaccgccaaataaagaaaaacggcgtgttgcacctgctgaaaaaaggcttggatattgatagcgcccattttgatttgctctaccccgttccgcttgccagcagcggcgaaaaggtcaagcagcgttttgaacagaatttgtttagctgtatgcgtcaagtgccttattctgcctcaagcaatgaaacggtggatatggtgctgtttgccaatggcttgccgattattgcccttgagctgaaaaaccattggacaggtcagacagccattgatgcgcaaaaacaatacctcaaccgtgatttaagccaaacgttgttccatttcgggcgttgtttggcgcattttgccttagatacggaagaagcttatatgaccaccaaattggcggggcctgctacgtttttcttgccgtttaacttgggcaacaactgcggtaagggtaatccgcccaatcccaatggacaccgcacggcgtatttatggcaagaggtgttcggcaaagcaagccttgccaacattattcagcattttatgcgcttagacggttcaaccaaagatccgttggataaacgtaccctctttttccctcgctatcaccaattagatgtggtccgccgtttgattgctgatgtcagtgaacatggcgtgggtaaacgttatttgattcaacattctgccggttcgggcaagtctaattccattacttggctggcgtatcagttgattgaggcatatccgcgcaatgaaaaggcggcaaacggtagagaggcagaccgcccgatttttgattcggtgattgtcgtaaccgaccgtcgtttgttggataagcaactgcgcgacaatatcaaagatttttcagaagttaaaaacattgttgcgccggcgttgagttcggcagagttgcgccaatcgcttgagcagggcaaaaaaatcattattaccacgattcaaaaattcccgtttattgtcgatggcattgctgatttaggcgacaaacaatttgcggtgattattgatgaggcacacagctcacaatcaggttcggcacacgacaatatgaaccgggccatcggcaaaacggaagaccttgatgctgaagatgtgcaagatttgattttacaaaccatgcaatcccgcaaaatgcacggcaatgcgtcgtattttgctttcaccgccacaccgaaaaacagcactttggaaaaattcggcgaaaaacaggcggatggcaagtttaagccgttccacctttattctatgaagcaggcgattgaagaaggctttattttggatgtaatcgccaattacaccacctataaaagtttttatgagatcactaagtcgattgaagataatccggagtttgatagtaaaaaggctcaaagccgtctgaaagcctatgtggagcgttcgcaacaaacgattgatactaaagcggagataatgctggatcattttatttaccaagttttcaaccgtaaaaaactcaaaggcaaagccaagggaatggtggtaacgcaaaatattgaaaccgccatccgctattttcaggcgttaaaacatttgctggccgggcggggtaatccgtttaaaattgcgattgcgttttcaggcagtaaagtggttgacggtgtcgaatacaccgaagcggaaatgaacggctttgcagaaagcgaaaccaaagagtatttcgatcaagatgaatatcgtttgctggtggtcgccaataaatatctgaccggtttcgatcagccgaaattgtgtgccatgtatgtggataagaaactctccggcgtgctttgcgtgcaggctttatctcgtttgaatcgcagtgcgaataagttgagtaaacgcacggaagatttgtttgtattggacttttttaacagcgttgaagatattcagcaggcatttgagccgttttatacttctacttcgttgtcgcaggcaaccgatgtcaatgtcttgcatgatttgaaagaccggttggatgaaaccggcgtgtacgaacaagcggaggtcaacgattttactgaaggctattttgccaataaagacgcacagcaattaagcagtatgattgatgtggctgtccaacgttttgatgatgaattggaattggatttggatcgaaatgaaaaagttgattttaaaatcaaggcaaaacagtttttaaaaatttacgggcaaatggcctccatcatcaattttgaaaatatcgcttgggaaaagctctattggttcctcaaattcttagtacccaaattaaaagtacaagacccgatggatgaatttgatgaaattttagatgcagtggatttaagctcttacggcttggcgcgcaccaagctgaattacagcattaaattagatgatgaagaaacagagcttgacccgcaaaaccccaatccgcgcggtacgcatggtgaagataaagaaaaagatccgattgatgaaattattcgtgtatttaacgaaagatggtttcaagattggagcgcaacgccggatgagcaacgggtaaaatttatcaatattaccgagcgcatccgcagccataaagactttgagcagaaatatcaaaataacccggatattcatacccgtgaattggctttccaagccattttgcgcgatgtgatgagcgaacgccatagggatgaattagagctatacaaactttttgccaaagatgccgcatttagaaccgcttggacgcaaagtttgcaacgggctttggctggatag

SEQ ID NO: 16 - DNA, 2238 bp, Haemophilus influenzae
atgaatattttaattaataaacgtatctttttattagttacccttgtaggtattcaactaaatgtaaccgcaaaacaaaattcttctaattctaatagagaggagttattacctattattgtgaacactaatgatgatagtaataaactacctggtcgttcagtattaaaacagaaaaatatcgaacaacaacaagctgataatgcagcaaacttaattaatatcttaccaggtgtgaatatggctggcggatttcgtcctggtgggcaaacattaaatattaatggaatgggtgacgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttag

SEQ ID NO: 17 - DNA, 2136 bp, Haemophilus influenzae
atgaaacaattatttgcaacgacttctcgtggctttgaagaattattaaaagttgaactcactgaacttggtgcgcaagaggcaaaagtggttcaaggtggcgttcattatcaagcagatgacgaaactttataccgcactttactttggtcacgccttgcttcacgcattttatttcctttgattgaaactaaaatttacagtgatttggatctttatgcggctgtttcaggctttaattggttagggctatttgatgaaagagttacattctttgtcgattttaatggaaccaaccaagaaattcgtcatactcaatttggtgcgatgcgcgttaaagatggaattgtcgattactttgaacgtcaaggtaaagctcgtcccgatgtagataaaattcagccggacgtgcgtatccatgcttatttgaatcgtgaaaatttagtgatttctttagatttaagtggggaagcattacatttacgaggctatcgtgaagatgcaggtcaagctcctttacgtgaaactctagctgcggcaattgttctgcgttcaggttggcaagtgggttctccattagtagatccaatgtgtggctctggcacgcttttaattgaggcggcacaaatggaagccaaaattgcaccgcaactttatcgtttacattggggatttgatttttggaaagcgcataatcaatcggcttgggaaaaagtaaaaaatgaagcgattgaattagcagaagaaaaacaacgtgaaattcaaccgcacttttatggatttgacctcgatcaccgcgtattaaaaaaggcgcaaaagaatgcacaaaatgcaggtgtttcacatttaattaaatggcagcaaggtgatgttgcagcgttgaaaaatcctcgtttaaatgaagtcggtacggttatctgtaatccaccttatggggaacgcttaggcacaaccccagcattgatcgcgctctattctgtatttgggcaaagacttaaaaaagaattttgtggttggaatgtttctgtttttagtagcgaatccacattacttgattgtttgagaatgcgtgccagccgacagtttaaagccaaaaatggcccattagattgtgtgcagaagaattatcaagtttcagaacgaaaatctgacgaaattaccgctgaaaatgaactagaatttaaccgcacttcggaggttgcaaccgattttgctaatcgattacaaaaaaatattaagaaaattagtaaatgggcaaagcaacaaggattagacgcttatcgtttatatgatgccgatttgccagaatataatttagccgttgatcgttatgcagattacattgttgtgcaagaatatgcagcaccgaaaaatattgatgaaaataaagcgcgtcagcgtttgttagatgcggttactgcaactttgcacgttacaggtgtagaaacgaataagttgatcctcaaagttcgtcagaaacaaaaaggtactaaccaatatgagaaattagccaataaaggcgaatacttttatgtgaatgaatatggcgcgcagctttgggtaaatttgacagattatttagacacgggcttatttttagatcaccgtttaacaagaaaaatgattggagcgttggcaaaaggtaaagatttcttaaatttatttgcttatactggttctgcaactgttcatgcggcacttggtggcgctaaatcgacaacgaccgttgatatgtccaatacttatcttaattgggcggagcaaaatcttattttgaatgatattgaaggtaaacaacataaattaattcaagcagattgccttcaatggttagaaaaatgtgatcgtcaatttgatttgatatttgtggatccaccgacgttttcaaattctaaacgtatggaagacagttgggatgtgcaacgagatcatgtgaaattaatgcgcaatctaaaacgagttttgtcgaataatggcacaattgttttctcgaataataaacgtggattcaaaatgaatttagttgcgttggaagaattaggtttaagtgcggtagaaatttcgcataaaaccttaccgttagattttgaacgtaataaacaaattcataattgttggatgattcaacatatataa

SEQ ID NO: 18 - DNA, 771 bp, Haemophilus influenzae
atggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaa

SEQ ID NO: 19 - DNA, 1002 bp, Haemophilus influenzae
atgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataa

SEQ ID NO: 20 - DNA, 1359 bp, Haemophilus influenzae
atgaaacatattcatatcttaggtatttgtggcacatttatgggcggtgtggcgatgattgctaaacaaatgggctatcacgtaacgggttccgatactaatgtttaccctccaatgaacacttttttagaagagcaaggtatcgagattattccaaattatgatgttgcacaattacaacctgcgcctgatatggtaattgttggtaatgcgatgaaacgtggtaatccttgcgtagaatatgtgttggaaaataatttgaaatatacatctggccctcaatggttacatgatcatttattgcgagatcgttgggtattggcgatttcaggtacgcatggaaaaacaaccacaacaggtatgctaacgtggatcttagaacaaaatggcttaaaaccaggttttttaatcggaggaattgcgggtaattttggcatttcagctcgtttaggagatagcccttattttgttattgaagctgatgaatatgatacagctttctttgataaacgttcgaaatttgtccattacaatcctcgtacacttatcgtaaataacattagttttgaccatgcagatatttttgatgatctcaaagcgatccaacgccaatttcatcatatgattcgaactatcccagccagtggcttggtattaagttcggcgagtgaacaaagtgcaaaagaaactttggcattgggatgttggtctcaacagcaatttttaggcaaagataacgagtggtttgctgaacgtattacaaatgatgcttcacattttgctgtcttccatcatggagaaaaagtggcagaagtaaaatggaatgtagtgggacaacataatatgcataatgcgttaatggcgatcgctgcggctcatcatactggcgttgctattgaagatgcgtgcaaagcgttgggatcttttgtgaatgctaaacgtcgtttagaagtgaaaggtgaagttaatggcattacggtttatgatgattttgctcatcatccagaagctattcttgctacgctaaccgctttacgagataaagttggtggtgttcgtattcttgcagtgcttgaacctcgttctaacacaatgaaaatgggtgttcacaaagatgacatcgcgcctgcacttggtcgagctgatgccgtgtttatgcttcaacctgaacaactttcttgggaagtggcagatattgcaaaccaatgtgtacaacctgcttattggaatgcaaatttagatcgattagtggatatgattgttgcagaggctcaacctacggatcatattttagtgatgtctaacggcagttttggtggcattcatcaaaaaattcttgataagctaaaactgaaataa

SEQ ID NO: 21 - DNA, 1098 bp, Haemophilus influenzae
atgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactgttgcaggagaagtttatccacaaaaaatcagcaatggcgttcaggttggtgcaaaatatgatgcaaacaacattattgcaggtattgcttatggtcgtacaaattatagagaagatattgttgacccagatttaggtaaaaaacaacaagtaaacggtgcgctttcaactttaggctatcgttttagtgatttaggcttattagtgtctctagatagtggctatgcaaaaactaaaaactataaagataaacacgaaaaaagctatttcgtatctccaggtttccaatatgaattaatggaagatactaatgtctatggcaacttcaaatatgaacgcgattctgtagatcaaggtaaaaaaacacgtgaacaagcagtgttattcggtgtagatcataaacttcacaaacaagtattaacctatattgaaggtgcttacgctagaactagaacaactgagcaagctaaaggcgtaaaaactgaaaaagaaaaatcagtgggtgtaggtttacgcgtttacttctaa

SEQ ID NO: 22 - DNA, 882 bp, Haemophilus influenzae
atgcgtgatttaaaaggtattttcagtgcattattagtgtcatttaatgaagatggcaccattaatgaaaaaggtttacgccaaattatccgccataatatcgacaaaatgaaagttgatggcttatatgtgggcggttcaacaggcgaaaactttatgctttcaacggaagagaaaaaagaaatcttccgcattgcaaaagatgaagcaaaagatcaaatcgcactaattgctcaagtgggcagcgtaaacttaaaagaagcagtggaattaggtaaatatgcaacagaattaggctacgactgcttatctgcagtgacgccattctattacaaatttagcttccctgaaattaaacattattacgacaccatcatcgctgaaacgggcaacaatatgattgtgtactcaatcccgttcttaactggcgtgaatatgggcattgaacaattcggtgaactttacaaaaacccgaaagtattaggggtaaaattcacagcaggtgatttctacttattagaacgtttgaaaaaagcttatccaaaccacttaatttgggcaggttttgatgaaatgatgttaccggcagcctcacttggtgtggatggtgcaatcggttcaactttcaacgtaaacggcgttcgtgctcgtcaaatttttgaattaaccaaagcgggtaaattagccgaagcgttagaaatccaacacgtaaccaacgatttaatcgaaggcattttagcgaacggtttatatttaaccatcaaagaattgcttaaattagaaggggtggatgcaggttattgccgtgaaccaatgacatcaaaagcaacagcagaacaggttgcaaaagcaaaagacttgaaagcgaaatttttgtcataa

SEQ ID NO: 23 - DNA, 1233 bp, Haemophilus influenzae
atggagaatgaaatgtcacagaacggttcagatcgcgatccttggagtaaaccagggcaaagcaacgaccaacagccgggaaattcatccaataataatggatggaataacaatcaaaatcgtggaaatcaagagcaatctccgccagatattgaggagatttttaataatctgcttaaaaaattaggtggtggaaataaaaagagcggtcaaaataatggcagttctcaaggcaatacgccatttcattttggcaaagttattccacttgctgtagcgattggtgcaattatttggggcgtaagcggtttttacaccattaaagaggctgaacgcggtgtggtgcttcgttttggcgagttacattctattgttcaacccggtttgaactggaaaccaacatttgtagataaagtattgccagtaaatgtggagcaagtaaaagagttgcgtacacaaggtgcaatgctgactcaagatgaaaatatggtaaaagtggaaatgaccgtgcaatatcgcgtgcaagatcctgcaaaatatctttttagcgtaacaaatgcagatgatagtttgaatcaagcgacagatagtgcattacgttatgttattgggcatatgtctatgaatgatattttaaccacaggtcgctctgtcgtgcgtgaaaatacttggaaagctttgaatgaaattatcaaatcctatgatatgggacttgaggttattgatgtgaacttccaatctgctcgtccacctgaagaagtaaaagatgcgtttgatgatgcaattaaagcgcaggaagatgaacaacgttttattcgtgaagcggaagcctatgcgcgtgagaaagaaccgattgcacgcggtgatgcacaacgtattcttgaagaagcaacagcttataaagatcgtatcgtgttagatgcaaaaggtgaagtggaacgtttgcaacgcttgttgccagaatttaaggctgcaccagatttactgcgtgagcgtttatatattcagacgatggaaaaagtgatggcaaataccccaaaagtaatgcttgatggcaataatggtaataatttaactgtgttaccgctagagcaaattatgggcaaaaaatcggtaacaagtgcgccaagtgcggtcaattcttcgcctgcttttactgcaccagaacgtcaaaattcttatcagcctcagccgactaccgttgcgccgattcgtcaagggagatttaactaa

SEQ ID NO: 24 - DNA, 2319 bp, Haemophilus influenzae
atgactatgtcagaacttaatgaaatgcaaaaattggcgtgggctggttttgctggtggcgattggcaagaaaatgtcaatgtacgtgactttatccaaaaaaactataccccttatgaaggcgatgactctttcttagcaggtccaaccgaagcaacaaccaagctttgggaatctgtaatggaaggaattaaaattgaaaaccgtactcacgcgccattagattttgatgaacatacaccatctaccattatctctcacgcacccggttacattaacaaagatttagaaaaaatcgttggtcttcaaactgatgaacctttaaaacgtgccattatgccattcggtggtatcaaaatggtggaaggttcttgtaaagtttatggtcgtgaacttgatccaaaagtgaaaaaaatcttcactgaataccgtaaaacacataaccaaggtgtattcgatgtttacacgccagatattttacgttgccgtaaatctggggtattaactggtcttccagatgcttatggtcgtggtcgtatcatcggtgactaccgtcgtgtagcactttatggtgtagatttcttaatgaaagataaatatgcacaattctcttctttacaaaaagatttagaagatggcgtaaatcttgaagcaacaattcgtttacgtgaagaaatcgcagaacaacaccgtgcattaggtcaattaaaacaaatggcagcaagctatggttatgatatttctaacccagcaactaatgctcaagaagccattcaatggatgtactttgcttatcttgctgcaataaaatcacaaaatggtgctgcaatgtcattcggtcgtaccgcaacctttattgacgtgtacattgagcgtgatttaaaagcaggaaaaattactgaaactgaagcgcaagaattagttgaccacttagttatgaaacttcgtatggttcgtttcttacgtacacctgaatacgatcaattattctcaggcgacccaatgtgggcaactgaaaccatcgcaggtatgggtttagatggtcgtacattagtaaccaaaaatacattccgtattttacacaccctttacaacatgggtacttccccagagccaaacttaaccattctttggtctgaacaattacctgaaaacttcaaacgtttctgtgcaaaagtatcgattgatacctcatcagttcaatacgaaaacgatgatttaatgcgtccagacttcaacaatgatgactacgcaatcgcatgttgtgtatcaccaatgattgtgggtaaacaaatgcaattcttcggtgcacgtgcaaacttagcgaaaacattgttatacgcaatcaacggcggtattgatgaaaaattaggtatgcaagtaggcccgaaaactgcaccaattactgatgaagtattagatttcgatacagtaatgactcgtatggatagctttatggattggttggctaaacaatatgtgactgccttaaacgtaatccactatatgcacgataaatattcatacgaagccgcattaatggcattacatgatcgtgatgtataccgtaccatggcttgtggtatcgcaggtctttctgttgcggctgactcactttcagcaatcaaatatgcaaaagttaaaccagttcgtggcgacatcaaagataaagatggcaatgttgttgcaactaacgtagcaatcgactttgaaattgaaggtgaatatccacaatatggtaataacgataaccgtgttgatgacatcgcttgtgacttagttgaacgtttcatgaagaaaattcaaaaacttaaaacttaccgcaatgcagtgcctacacaatctgtattaaccattacttctaacgtagtttatggtaagaaaacgggcaacaccccagatggccgtcgtgctggtgcaccattcggaccaggtgcgaacccaatgcacggacgtgaccaaaaaggtgcggtagcatcattaacttctgtagctaaacttccatttgcttacgcgaaagatggtatttcttataccttctcaatcgtaccaaatgcgttaggtaaagatgccgaagcacaacgtcgcaaccttgctggcttaatggatggttacttccaccacgaagcaacggttgaaggtggccaacacttaaatgtgaacgtgttaaaccgtgaaatgttgttagatgcaatggaaaatccggataaatatccacaattgactatccgtgtatctggttacgcagtacgttttaactctttaactaaagagcaacaacaagacgtaattactagaactttcacagagtcaatgtaa

SEQ ID NO: 25 - DNA, 3339 bp, Haemophilus influenzae
atgattaggaaacttatgaaaacacctccattttttaccgtactttttgcctcggcaatgtttacccttagtgtttcacaaggggcattaggggcaaattcaacaaatgtattaccaacggagcaatcgcttaaagccgatttggctaacgctcaaaaaatgagtgagggggaagcaaaaaatacgttgttagcagaattacaaacatcaattgatttattgcagcaaattcaagctcaacaaaaaatcaatgatgcattgcaaacaacattaagccattcagagagtgaaattagaaagaataatgcagaaattcaagcattaaaaaaacaacaagaaacagcaacaagtactgattataatgcacagtcacaggacgatttacaaaatagtctcgctaagttaaatgatcaattacaagatacgcaaaacgcattaggcgcggcaaatgcacaattggcagggcaaaattctatttctgaacgagctcaagcggcattaacggaaaatgttgtacgcactcagcaaattaatcaacaattggccaataatgatattggtagcgcattacgaaaacaatatcagattgaattacaactgattgatttaaagaatagttataatcaaaatttattaaaaaataatgatcagctttctttactttatcaaagtcgttacgacctattgaatttacgtttgcaggtgcaacaacaaaatattattgcgattcaagaagtcattaatcaaaaaaatcttcagcaatcacaaaatcaactagaacaagctcagcagcaacagcaaaaaactgtgcaaaatgattacattcaaaaagaacttgatcgcaatgcacagcttggtcagtatctattacaacaaacagaaaaagcgaattcattaactcaagatgagttaagaatgcggaatattttagatagcctcactcaaactcaacatactattgatgaacaaattagtgcattacaaggcacgttagttctttcacgtattatccagcaacaaaaacaaaaattaccgactaacttaaatattcaaggtttatcaaaacaaattgccgatttgcgtgtgcatatttttgacattactcaaaaacgcaatgaactttatgatctaaataactatattaataaagttgaaagtgaagatggaaaacaatttactgaggcagaaagaacgcaggttaaaacgctattaactgagcgtcgaaaaatgacatctgatctgattaaatctttaaataatcaattaaatctcgcgatttctttggaattaacgcagcagcaaattacacaaatcagtgatcaaattcaatctaaattagagcagcaaagtttttgggtgaaaagtaataatcccattaatttagattggataaaaatgctgccaagagctttaattgaacagtttaatggtatgttgaaaaaattaggttttccaactaattatgacaatttaccttatttacttatgtatttcttagggttatttattgtaggtggtgcaatttttaaatttaaaaatcgtattaaacaacaattaaacaaaattaatcgtgaaatacatcgcttagatacagatagtcagtggagtactccacttgccctgttattaactgcgtttttaacgctttctagtacactttggtttttagccgtttgccaaatgatcggcttctttttcttcaaaaatccagaagaattttggcattggtcatttagtatggcaggttattggtggttctttacattttggatttcattgttccgtccaaatggtatttttgttaatcattttgaatcttcaaaagagaatgcacaacgttttcgtggtgttatccaacgcattattattgtgattgtattgcttttaaatacttctgtgtttagcaatgtcactgatgcaggtttagctaatgatgtgttaggtcaaattaatactattacagctctaattttctgtgcggcgattattgctcctcgctttaatcgagtacttcgctcttatgaacctgaaacaaataaacatcattggttaataagaattgtacaaattggtttaagattaattcctgtgggactaatcgtacttattgttttaggctattattacactgctttaaatttaattgagcattttattcattcttatattgcttggtgtgtatggtggttagtacgtaatacgatttaccgtggtattacggtttcttctcgtcgtttagcacatcgccgtttagcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataa

SEQ ID NO: 26 - DNA, 1089 bp, Haemophilus influenzae
atgttgtgcgtcaatgtggaattgcaagagcgtcgctatcctattttaattggtagcggattgttacaagatgaacgtagttacccgattaaacgtggggatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaagataatcatgggcgagataccacgattattgcattgggcggcggcgtaattggcgatgttgctggctttgtggcggcaagttatcagcgcggtgtgcgtttaattcaaatgccaaccacattgctttcacaagtggattcttcagtgggcggtaaaacggcggttaatcatgaattaggcaaaaatatgattggcgcgttctatcagccatcaatggttattattgatacgctcacgcttaatacgcttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgttgcgagagatgaaacagaaaaaggcgatcgtgcattgcttaatcttggacatacttttggacatgccattgaaactcacttaggttatggaaactggcttcatggtgaagctgtttcgacgggaatgatgatggcagcggtgctttcggaagaacttggagatatttctattgcagatgtgtctcgccttgaaaaattacttgctcgtgccaatttgcccaccgtatcaccggatacgatgcagccagaagactatttaccgcatatgatgcgtgataaaaaagttctatcgggtaaattgcgtctggtgttactcaaatctctaggccaagcttatgtggcgaatgataccgatcataccctcgtgttaaacgcaattcgtcgttgtactcaaacggattaa

SEQ ID NO: 27 - DNA, 1842 bp, Haemophilus influenzae
atgcacaggtttttttataacgataataatgttttaggagatttgatgaaaaatttcaaatattttgctcagagttatgtggattgggttattcgtcttgggcgtcttcgtttttctcttttaggcgtgatgattctcgcggttttagccctttgtactcagattttatttagtctatttattgttcatcagatatcttgggtagatatttttcgttctgtaacttttggcttactcactgcgccttttgttatttattttttcactttattagtagaaaaacttgaacattctcgtcttgatctttctagctcggttaatcgattggaaaatgaggtcgccgagcgaattgctgctcagaaaaaattatcccaagcattggaaaagttagaaaaaaatagccgtgataaaagtaccttacttgccacaataagccatgaatttcgcacgccattgaatgggattgtcgggcttagtcaaattttacttgatgatgaattggatgatctccagcgtaattatttaaaaactatcaacataagtgcggtcagtttaggctatatttttagcgatattattgatttggaaaaaattgatgccagccgaattgaattaaatcgccagccaacagatttccccgccttattaaacgatatttataattttgctagtttcctcgccaaagaaaaaaatcttattttttctttagagcttgaacctaatttgcctaattggttgaatcttgatcgtgttcgcttgagccaaattttgtggaacttaattagtaatgcggtgaagtttacggatcagggaaatattattcttaaaattatgagaaatcaggattgttaccattttattgtgaaagatacaggaatggggatttcacctgaagaacaaaaacatatttttgaaatgtattatcaagtgaaagaaagccgtcagcaaagtgcgggtagcggtattgggttggctatttctaaaaatctcgctcagttaatggaaggggatttaacagttgaaagtgagcgaggaaaaggcgcgactttccatcttactctccacgctcaggaaatttctgaaaaagaatctgttaagaaaaatataccatccttgaatattcttttagtggaagatgttgatctcaatattatggttgcaaaaactattttagaaaaacttgggcatcatgttgatgttgcgacaaatggcaagcaggcgattactttatttgagaaaaatgtttacgacattctattgctcgatattaaattaccagatatgagtggttttgaaattgcccaatatttgcgagagaactatgaaaacggtatttatgattttttaccgccaatgattgcttttaccgcgaatgttatgcaaagcgagcaagaatatttagaaatgggcatggatggcgtattacgtaaacccatttcaattaaggatttacaccattgtctacagcaattttttgcagatgaaagcgaatctattatagaaatgaatgatgataatgagctttcagaacagtttgatttagcgctgatagaaacacttggaaaaaaacaaattttagaaaatttatctttattcaaacaaactatgccaaattatctggctcaattatcaaaagataatatgaaagaaacagaagataccgcccataaaattaaaggcgcagcggcatcggtagggttaaatcatttacgtcaattagcggatactttagaaagtgcggctaaaaattctgatgtttttaattgtggagaattgattgatgaaattggaaatctttggttagaagatgtggaggatttgcttaaattttgtaaattttaa

SEQ ID NO: 28 - DNA, 2130 bp, Haemophilus influenzae
gtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataa

SEQ ID NO: 29 - DNA, 1389 bp, Haemophilus influenzae
atggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcagaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaacttggaaaagaaatcaagcacttactcaagaagaactattactacaactggctgaaggcaaaattccttacgttattgcaaattctattgatattgctgcaattcaacaaatcaaaccagaattagccattgcctttgatattactgatgaagcaaacgttcactggtatttacccaatagcccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagaatatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggctcaatgtgaaaaaaaatctgcctttattagcagaaaaacgctattattcccaactgaaatacggctatgcaagaggctatgaagcctatcaatatgtagaaaatattcgccgctatatgaatagcatcgtaaattatcatcgagtccaagaaaatcaaacaacgaatgataatgccaacaacgaaagtgcggttaaaaatttagaagaaataaaagaaaataaggattaa

SEQ ID NO: 30 - DNA, 1092 bp, Haemophilus influenzae
atgcgtgtttcagactttaactttgatttacccgatgaattaattgctcgttatcctaaaactgatcgtgtttcttgtcgtttattacagttaaatggtgaaaacggagaaatttttcaccgcactttttctgatgtattagatttaattgatcaaggcgatttattgatttttaataatacgcacgttattcctgcaagaatgtttgggcgtaaagccagtggtggaaaaattgaagttttagttgagagaatgttagatgaacatcgtttcttagcgcatattcgttcatcgaaatcccctaaagaaggggctgaattatttttaggggaagataaattaggcgaaaataatggcattaaagcagtaatgaaagctcgtcatagctcgttgtttgaagtggaattaagtgataaatcaaccgctcttttagatgtgttgcaaaccattgggcatatgccattaccgccttatatcgatcgtccagatgaagaagccgataaagaatgttatcaaacggtttatagtaaagtaccaggtgcggtagcagcaccaacggctggtttgcattttgataaaaatttacttgaaaaactcaaagcaaagggtgtgaattttgaatttgttacattacatgtaggcgcaggaacattccagcctgttcgtgtggaaaatattgaagatcatgtgatgcatgcagaatacgtagaagtttctcaagaagtttgcaatgcgattatcgcaacaaagaaagcgggcaaacgtgtaattgcagtgggaactacttctgttcgttctattgaaagtgcggcactttctgcggaagaatttggcaatccagatttaattgagccttatttttctgatacctctatttttatttatccagggaaaaaattccgagtggtggattgcttaattactaatttccacttacctgaaagcactttgattatgttagtttcagcttttgctggttataaaaataccatgaatgcgtataagcatgcagtgcaagaaaaatatcgtttctttagttatggcgatgcgatgtttattaataaaaattctaatgtgagagagttggaataa

SEQ ID NO: 31 - DNA, 4179 bp, Haemophilus influenzae
atgaaaaaaactgtatttcgtctgaattttttaaccgcttgcatttcattagggatagtatcgcaagcgtgggcaggtcacacttattttgggattgactaccaatattatcgtgattttgctgagaataaagggaagtttgcagtcggtgcgaaagatattgaggtttacaacaaaaaaggggagttggtcggcaaatcaatgacaaaagctccgatgattgattttgcatctgttgctcgtagtggttatgctgcattagtaggcgatcaatatattgtaagtgttgctcacaatgggggatacactaatgctgattttggtgcggaaggacaaaatcccgatcaacatcgttttacttatcaaatagttaaacgtaataattataaacctgatcagaagcatcattataatggggattaccatatgcctcgtttacataaatttgtaactgaaagttctccttttgatatgacaggaagtatgaagggacagacctatgcagacaaagaaaaatacccgatgcgtgtgcggattggttctggtgatcaatattggagaaatgaacaagataaaggaactcaagtagctgaagcttatggatatcttattgcggggaatacccatatgcaaactggtgcaggaaatggagatgttagtttaagtggcgatgtacgtaaaggaaatgattatggacctatgccgacagcaggatcatttggagacagtgggtcacctatgtttatttatgatgctaccgagaaaaaatggcttataaatggtgtattgcgtactggaaacccatccttaggtagagagaatacttttcagctagtccgtaaaaattattttgatgaaattttctctgctaatcttaaaacgaccatatttgatttcagaactcctaaaaatcaacaaaatcagcactacacatttcattcaaaaaatgatgggtcaggcactattacatctggagctggtaaaatttataaagtcaaacttgctaattacaatttatctatgaaaggcacggagcctgtctatactaatggtggtgtaaacaattattctcccgcattaagtcacggcgaaaacctttattttattgattacggaaaaggggtgctaacttttagtaataatatcgatcaaggtgcaggcggtttgtattttgagggagattttatagtttcgcctacccataatgaaacgtggaaaggggcggggatatctatcagtgatgaaagcaccgtaatttggaaagtcaatggcgtagaaaatgatcgcctttctaaaattggtaaaggaacgttacatattcaagcaaaaggtaaaaacttaggctcaattagcgttggcgatggtaaagtaatcttagaacaacaagaggacgatcaacataaaaaacaagcctttagtgaaatcggattggttagcggcagagggactgtccaattaaacgatgataaacaatttgataccgataaattttatttcggctttcgtggtggtcgcttagatcttaatgggcattcattaacctttaaacgtatccaaaatacggacgagggggcgatgattgtgaaccataatacaactgaagtcgctaatgtcactattactgggaacgaaagcattgttctacctaatggaaataatattaataaacttaattacagcaaagaaattgcctacaacggttggtttggcgaaacagatgaaaataaacacaatggacgattaaaccttatttataaaccaaccacagaagatcgtactttactactttcaggtggcacaaacttaaaaggcgatattactcaagaaggcggcactttagtgtttagtggtcgcccaacgccacacgcttacaatcatttaaatcgcccaaacgagcttgggcgacctcaaggcgaagtggttattgatgacgattggatcaaccgcacatttaaagctgaaaacttccaaattaaaggcggaagtgcggtggtttctcgcaatgtttcttcaattgagggaaattggacaatcagcaataacgccaacgccacatttggtgttgtgccaaatcaacaaaataccatttgcacgcgttcagattggacaggcttaacgacttgtaaaacagagaatttaaccgacacaaaagttattaattctataccaacaacacaaatcaatggctctattaatttaactgataatgcaacggcgaatgttaaaggtttagcaaaacttaatggcaatgtcactttaacaaatcacagccaatttacattaagcaacaatgctacccaaataggcaatatccgactttccgacaattcaactgcaacggtggataatgcaaacttgaacggtaatgtgcatttaacgaattctgctcaattttatttaaaaaacagccatctttcgcaccaaattcagggcgacaaaggcacaacagtgacgttggaaaatgcgacttggacaatgcctagcgataccacattgcagaatttaacactaaataacagtactgttacgttaaattcagcttattcagctagtccaaacaatacgccacgccgtcgtcgccgttcattagagacggaaacgacgccaacatcggcagaacatcgtttcaacacattgacagtaaatggtaaattgagcgggcaaggcacattccaatttacttcatctttatttggctataaaagcgataaattaaaattatccaatgacgctgagggcgattacatattatctgttcgcaacacaggcaaagaacccgaaacccttgagcaattaactttggttgaaagcaaagataatcaaccgttatcagacaaactcacattcacgttagaaaatgaccacgttgatgcgggtgcattacgttatgtattagtgaagaataatggcgaattccgcttgcataatccaataaaagagcaggaattgcacaatgatttagtaagagcagagcaagcagaacaaacattagaagccaaacaagttgaaccgactgctgaaacacaaacaagtaaggcaaaagtgcggttaagaagagcggtgttgcctgataccctgcctgctcaaagcctgttaaacgcattagaagccaaacaagctgaaccgaatgctaaaacacaaaaaagtaaggcaaaaacaaaaaaagcgcggtcaaaaagagcattgagagcggtgttttctgatcccccgcctgatcaaagccagttagacgtattaaaagccgcacttgaggttattaatgcccaaccgcaagtgggaaaagaacgtcaagctcaagagaaacaaggcaaacaaaaagacttgatcagccgttactcaaatagtgcgttatcggagttgtctgcaacagtaaatagtatgctttccgttcaagatgaattggatcgtctttttgtagatcaagcacaatctgctgtgtggacaaatatcgcacaggataaaagacgctatgattctgatgcgttccgtgcttatcagcagaaaacgaacttgcgtcaaattggggtgcaaaaagccttagataatggacgaattggggcggttttctcgcatagccgttcagataatacctttgacgaacaggttaaaaatcacgcgacattaacgatgatgtcgggtttcgcccaatatcaatggggcgatttacaatttggtgtaaacgtgggcgcgggaattagtgcgagtaaaatggctgaagaacaaagccgaaaaattcatcgaaaagcgataaattatggtgtgaatgcaagttatcagttccgtttagggcaattgggtattcagccttatttgggtgttaatcgatattttattgaacgtgaaaattatcaatctgaagacgtgaaagtgcaaacaccgagccttgcatttaatcgctataatgctggcattcgagttgattatacgtttaccccgacagataatatcagcgttaagccttatttcttcgttaattatgttgatgtttcaaacgctaacgtacaaaccactgtaaatagcacgatgttgcaacaatcatttgggcgttattggcaaaaagaagtgggattaaaggcagaaattttacatttccaactttccgcttttatctcaaaatctcaaggttcacaactcggcaaacagcaaaatgtgggcgtgaaattggggtatcgttggtaa

SEQ ID NO: 32 - DNA, 795 bp, Haemophilus influenzae
atgcagcaaacaaaacgttcgctattgggtttgcttatttctttgatcgcacacggtattattataggatttatcttatggaattggaatgagccaagtgatagtgcaaatagcgcacaaggcgatatatctacaagtatttctatggaactattacagggcatggtgttggaagaacctgctccagagccagaagatgtacaaaaagagccagagcctgagccagaaaatgtacaaaaagagccagaaccagaaaaacaagaaattgtagaagatccaacaataaaacctgaaccgaaaaaaatcaaagaaccagaaaaggaaaagccaaaaccaaaagaaaagccgaagaataaacctaaaaaagaggttaaaccacaaaagaaaccaatcaataaagagctaccaaaaggcgatgaaaatattgattcaagtgccaacgtaaatgataaagcaagtacaacaagtgcagctaatagcaatgcacaggtagcaggaagtggaacggatacgagtgaaatagcggcttaccgttctgcaatccgccgtgaaattgaaagccataaacgttatccaactcgagcgaagataatgcgcaaacaaggaaaagtgagtgtatcttttaatgtaggagctgatggttcattaagtggtgctaaggttacaaaatcctcaggcgatgaaagtttagataaggcggcattagacgctattaacgtatctcgctctgttggaacaagacccgcaggattcccttcgagtttaagtgtgcaaattagttttactcttcaataa

SEQ ID NO: 33 - DNA, 630 bp, Haemophilus influenzae
atgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataa

SEQ ID NO: 34 - DNA, 2130 bp, Haemophilus influenzae
atgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaa

SEQ ID NO: 35 - DNA, 1698 bp, Haemophilus influenzae
atgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaa

SEQ ID NO: 36 - DNA, 2766 bp, Haemophilus influenzae
atgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcaattaacactggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataa

SEQ ID NO: 37 - DNA, 1704 bp, Haemophilus influenzae
gtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttgtccagatccccgaattatgcaaaatttagcgcaaatgcttgctcgtgcgctttatttccataaaaatttacgtcagaaagaacagattttattaatggaagaacgctcaattattgcgcgagagttgcacgattctttggctcaagtcttatcatttttacaaattcaacttactttgctcaaacataacctgaagaaagaagacgaacaatcaaaagaaaagagtttggcaattattgccaattttgaacaagccctttctggtggttatgcacagttacgtgagcttttagccactttccgtttaactatacaagaagcgaatttacagcttgcactaaaacaagtgattgattcattacgctcacaaacaacaatgcaaatgaatgtgaattgtcaattaccatcgcaaagtttgaaccctcaacagctggttcacgttctgcaaattgtacgtgaagccaccaccaatgcgatcaaacattctcaaggcacggtaattgaaattagcgcaagaattaatgcggaaggcgagtatgaaattttagttgaagatgatggggttggcattccaaaccttgaggagcctgaagggcattacggcttgaatattatggcggaacgttgccgtcagcttaatgcacaattgcatattcatcgccgagaacaaggcggcacacaagtcaaaattaccttgccacatacattatattag

SEQ ID NO: 38 - DNA, 1026 bp, Haemophilus influenzae
atgcaaaatttacaaccttttcacactttccacattcagtctaatgctcgtgaaattattgaagcacatagtatcgaacagctacaacaagtgtgggcgaattctaaatcagaaaatttacccgtactttttttaggtcaaggcagtaatgttctgtttctggatgattttaatggcgtggtggttttaaatcgtttaatggggattacgcacgaacaagatgcaaattttcactatcttcacgtcaatggcggcgaaaattggcataaattggtggaatggtctattaataatggtatttatggcttagaaaatctggctttaattcctggctgtgcaggatctgcgcctattcaaaatatcggtgcttatggcgttgaatttaaagatgtgtgcgattatgtggatgtacttaatttaaacacgaatgaaacctttagactcgacacagaacaatgtgaatttggttatcgtgaaagtacttttaaacatcgttatcagcaaggttacgtgattacagcggttggattaaagcttaaaaaagattggcagcctattctaaaatatggttcgcttgtagacttcgatccaaaaactatcacggctaaacaaatttttgatgaagtctgtcatatccgtcaaagtaaattacctgatccaaatgaaacgggtaatgcagggagtttctttaaaaatccagttgtcagttcagaacattttgaggaaatcaaaaaacatcacaaaaatctaccgcactttccacaagcagatggctcagtgaaattagcggcaggctggctgattgatcaatgtaatcttaaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaa

SEQ ID NO: 39 - DNA, 1443 bp, Haemophilus influenzae
atgaaactagatgctccttttaatttagatccaaatgtaaaagtgcgtactcgttttgctcctagccctacaggttatttacatgtaggtggcgcacgtaccgcactttattcttggttatacgcaaaacataataacggcgaatttgtattacgaattgaagacactgatttagagcgttcaacaccagaagcaacggctgccattattgaaggcatggaatggttaaatcttccgtgggagcatggcccttattaccaaactaaacgctttgatcgttataaccaagtgatcgatgaaatgattgaacaaggcttagcatatcgttgttattgtactaaagaacacttagaagaacttcgtcatactcaagaacaaaataaagaaaaaccacgttatgaccgtcactgcttacacgatcacaaccattcacctgatgaaccccatgttgtacgttttaaaaatccaactgaaggctcggtagtatttgatgatgccgtacgtggccgtattgaaatcagcaacagtgagcttgatgatcttattattcgccgcacagacggttctccaacttataacttctgtgtagttgtagatgactgggacatgggtatcacacatgttgtacgtggcgaagatcatatcaacaacacgcctcgtcaaattaacattttaaaagcgattggtgccccaattccaacctatgcacacgtttctatgattaatggcgatgatggtcaaaaactctctaaacgacatggcgcagtgagcgtaatgcaatatcgtgatgatggttacttacccgaagctttaattaactatcttgttcgtttaggctggggacatggcgaccaagaaatttttagtcgcgaagaaatgatcaactatttcgaattagatcacgttagcaaatcagctagcgcatttaataccgaaaaattacaatggttgaatcaacattatatccgcgaattaccgccagaatatgtggctaaacatcttgaatggcattacaaagatcaaagcattgatacaagcaatggtcctgcattaactgatattgtctccatgcttgcggaacgttgcaaaaccttaaaagaaatggcaagttcaagccgctacttctttgaagagtttgaaacctttgatgaagccgcagcgaaaaaacatttcaaaggcaatgctgctgaagcgcttgcaaaagtgaaagaaaaattaaccgcactttctagctggaatttacattctattcacgaagccattgagcaaacagctgctgaactagaagtgggcatgggtaaagttggcatgccattacgtgtcgctgtgacaggttctggtcaatcgccatcaatggatgttaccctagtcggtatcggcagagatcgcgtacttgtgcgtattcagcgcgctattgattttattcatgcacaaaacgcttaa

SEQ ID NO: 40 - DNA, 1221 bp, Haemophilus influenzae
atgactaaaaaactcttttattatcaaggtagtaacgcattaaatcagaaacaaaaaggctcaattattgcggatacgaaacaacaagcgcactttcagttaataagccgcgggcttactcacatcaaattacaacaaaactggcaatttggggcaaaacccaaaaattcagaaatcagtgaattactcaatcaattagcgacattgctacagtccgtaattccgttaaaaaacagcctacaaattttgcaacaaaattgtactcaaattatgctcaacaaatggcttgaacgactgcttcaatccattgaatctggcttagcattctcacaagccattgaacaacaaggaaaatatctcacacaacaagaaattcaactgattcaagtgggagaaatgacaggaaaacttgccgtagtttgtaaaaaaatagccacgcaccgtagtcaatctttggctttacaacgcaaattacagaaaattatgttatatccctcaatggtattgggaatttctctattattgacactcgcattactgctttttatcgcgcctcaatttgctgaaatgtacagtggcaataatgcggagttaccaacaataaccgcaatattgctctcaatatctaatttccttaagcaaaatattggcattttgctatttttcgttttgagtttttttctattttattatttctatctaaaacgccagacttggtttcatcaaaagaaaaatcaacttatttctatcacgcctatttttggcacaattcaaaagctttcacgtttagtgaactttagtcaaagtttacaaattatgttgcaggccggcgtaccgcttaatcaggcactagacagttttcttcctcgcacacaaacttggcaaaccaagaaaacgcttgtaaacgatatggtattagataaagaagtgcggtcaattttgcaatgggtttctcaaggctatgcgttttctaatagcgtaagtagcgatcttttcccgatggaagcacaacaaatgctacaaattggcgaacaaagcggaaaactcgctttgatgctagagcatatcgcagataattaccaagaaaaacttaatcatcaaattgacttactctcacaaatgctagaaccattaatgatggtaatcatcggcagtctgattgggattattatgatgggaatgtatttacctatctttaatatgggatcagttattcaatga

SEQ ID NO: 41 - DNA, 1395 bp, Haemophilus influenzae
atgacgagctatgctttacttcatactcagcgtgtaaccgctcaaaatggcgagatctttacgatctcgccagatttatgggaacgcaatcagcagcaacaatccttgctcttgcggtattttgctttgccacttaaagaagaaaataatcgtctttggctaggggttgattctctctccaatctttcagcttgtgaaaccattgcgtttataacaggaaaacctgtcgaaccaattttgttagaaagcagccaactcaaagaactgttacaacaacttactccgcaccaaatgcaagtggaagagcaagttaaattctatcaacatcaagaaacccattttgaacaagaagatgatgaacctgttatccgcttacttaatcagatttttgaatctgccttacaaaaaaatgcctctgatattcatttagaaaccttggctgatcagtttcaagtgcggtttagaattgatggtgttttacaaccacaacccttaataagcaaaatattcgccaatcgtattatttcacgcttaaaattactggctaaattagatattagtgaaaatcgacttccacaagatggacgatttcaatttaaaaccactttttccgatattcttgattttcgcctttcaaccttaccaacccattggggcgaaaaaatcgtgttgcgagcgcaacaaaataaacctgtagaacttagctttgctgaactgggtatgaccgaaaatcagcaacaagcatttcaacgctcacttagccagccacaaggattaattttagtaaccggccccacaggaagtgggaaaagtatctcgctttacaccgcacttcagtggctaaatacgcctgataaacatattatgaccgctgaagatcccattgaaattgaacttgatggtattattcaaagccaaattaatccgcagattggattagattttagccgtctattgcgtgcttttttacgtcaagatcccgacatcattatgctaggtgaaattcgagatgaagaaagtgcaaggattgcactacgtgccgctcaaacgggacatttggtgctttcaactttacataccaatgatgcaatatctgccatttctcgcttacaacaactcggtattcaacaacatgaaattgaaaacagtttactactcgtcattgcacagcgtcttgtacgaaaaatctgtccaaagtgcggtggaaatttaataaattcttgtgattgccatcaaggttatcgagggcgaatcggcgtgtatcaatttctacattggcaacagaatggctatcaaacggattttgagaatttacgagagagtggtttggaaaaagttagccaaggcataacagatgagaaagaaattgaacgtgtgttaggtaaaaactcatga

SEQ ID NO: 42 - DNA, 1296 bp, Haemophilus influenzae
gtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataa

SEQ ID NO: 43 - DNA, 2193 bp, Haemophilus influenzae
atgaaaattgtccgagtggcactggctgtgccgcttcctcgcttatttgattatttcgtccccgatgatgtttcattacaaatcggtatgcgtgttcttgtgccttttggcactcaaaaacgtgtcgccattgtggctgattttccgacaaaatcggacgtgccagaggataaactcaaggctattcttcaaccattggatttagccccactttttacgcccatttattgggattggcttcactgggcagcaaattattatcaagcgggattaggcgatgtgttatttcaagccttgcctgtgaaattgcgtaacggcgaaagtgcggtaaaaaatgaccgcactttttggcgaattacggatgcggggaaaaatgcccttgaacaaggcgaattaaaacgctcgaaaaagcaagctgaagccctacaatgcttatctgaaactgatcttgaaaaaggcaataataatttttcctctgccatttggtctgccttaaaagccaaagggtttattgaagaaattactatccaaacaaatcccctaagctggcaacaaagattaggcaataacccaatagtcaatgctgaaaatcgtttaaccttaaataagcagcaagccttagccttcagccaactgctcttccattctggtttcaatgtatggctgctcgatggcgtgactggttcaggtaaaacagaaatttatctgcagtatattgaagaaattttaaaatcgggtaagcaagtattagtgcttgtacccgaaatcgggctaacacctcaaacggtgcaacgttttaaagcacgttttaatgtagaaattgatgtactgcattctaatttaaccgatacgcaacggctttatgtatgggatcgcgcccgctctggacaaagtgccattgtgattggcacgagatcggcattgttcacgcaattttctaatcttggtgcaattattttggacgaggaacacgattcgtcttacaaacaacaagacagttggcgttaccatgcgcgagacttggcgattgtgctggctcaaaaactaaatattgcggtattaatgggctccgccacgccaagtttagaaagtattaataatgtacaaaacggcaaataccaacatttagttttatcaaaaagagcgggaaattctaccgcacttcgtcatttcgttattgatttgaaaaatcaaaatatacaaaacgggttatcaaaacccttgttggaacgaatgaaagcccatctcgaaaaaggcaatcaagtgttgcttttcttaaatcgtcgtggctttgcacccgtattgctttgccatgaatgtggttggatcgcacaatgccctcattgtgaaaaaccttatacctatcatcagcatcaaaatgtattgcgttgtcattattgtggcgcacaaaaaactattcctcgccaatgtggcgattgcggttctacccatttagttactactggtctaggcacagaacaattagaagaaaccttgaaaacgctatttcctcattattctgtagcgcgaatcgaccgcgatagcacggcacgtaaaggaaaattggaaggttatttagaagatattcaacaaggcaaaagccaaattttgattggcacacaaatgctcgcgaaaggacatcattttccgaatgttactctcgttgccttagtgaatgtagatagtgcattattttcactggattttcgtgcagaagaacgtttagctcaactttatattcaagttgctggacgtgcaggacgtgccgataaacaaggtgaagttgtgctacaaacacattatcctgatcatcctttgcttaccactttattggcaaatggctaccaagcttttgcaaaagaaaccttacaattacgccattcaatgggattgccgccttttacttttcaggcgttattcaaagcacaggctcgacattctgatcttgcagaaaattgcttaagccaaattgcagatttttttcaatcgaagcaaattacgggattacaaatgcttggcccaatgcctgcaccgttcagcaaaaaagcggggcaatatcgctggcagttattattgcaacatccgtcaagaatgacgttgcaaaaagcattaagagaatatcaacaagccgaacttgaaaaaaacagcctagtgcggttaattttggacgtcgatccgcaagacttatcataa

SEQ ID NO: 44 - DNA, 2499 bp, Haemophilus influenzae
gtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaa

SEQ ID NO: 45 - DNA, 963 bp, Haemophilus influenzae
atgtcaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaagatcattattttcttggcaagaaaataaaaaaggtattttttaattgttctgtaatttttgaacaatactatacgtttatgcaattaattaaaaataatgaatataaatatgaatatgctgatattatcttagcatcttttctgaatttaggggattcaacattaaagaaaatccagcatttagaaaaattactgccacaaattgatcttggtcattgctatttgaaaaaactacgagcttttaatgctcatttacaatatcacgaattatatgagaataagaggattacatcaggcgtttatatgtgtgcagtggcgactgcaatgggttataaagatctttatttaacaggtattgatttttatcaagaaaaagggaatccttacgcatttcatcatcaaaaagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattattttcctttatcaccactgaataacccaattgcttttattccagaagaaaagaaaaattacacacaagatattttaattccgccgaagtttgtatataaaaaaattggtatatattccaaaccaagaatttaccaaaatctgatttttcggttgttctgggatatattacgtttacctaatgatataaaacacgccttaaaatcaagaaaatgggattag

SEQ ID NO: 46 - DNA, 1227 bp, Haemophilus influenzae
gtgcaaaataatcgacaaaagaaaggaatcaatgcttttgctatttctatccttttgcactttatcttgtttggcttattgattttaagttcgctttatcacaccgttgaaattatgggtggtggagaaggtgaaggagatgtaataggggcagtgattgttgatactggtacggctgctcaggaatgggggcgtattcaacaacaaaaaaaagggcaagcggataaacaaaaacgcccagaacctgttgtggaagaaaaaccacctgagcctaatcaagaagagattaagcatcaacaagaagttcaacgacaagaagagattaagcatcaacaagaagttcaacgacaagaagagttaaaacgtcagcaagaacagcaacgtcagcaagaaataaaaaaacaacaagagcaagctcgtcaagaagcgttggaaaaacagaagcaagctgaagaggctagggctaaacaagcggctgaagctgcaaaattaaaagcagatgcagaggctaaacgtttagctgctgcggcaaaacaagctgaagaagaggctaaagcgaaagcagcagaaattgctgctcaaaaagcaaaacaagaggcagaaactaaggcgaaactagaagcggaagctaaggcaaaagccgctgctgaagctaaagcaaaggctgaagcggaggcaaaagcgaaagcagcagctgaggcaaaagcaaaggctgaagcggaggcaaaagcgaaagcagcagctgaggcaaaagcaaaagctgatgcagaagctaaagcgaaagccgctgctgaggcaaaagctgctgcggaagcaaaacgtaaagcagatcaagcaagcctagatgatttctttaacggcggagatgttggtggcggtagtgcatctaaagggggaaacacaaataaaggtggaactcaaggtagcggtgctgcacttggctctggcgatggtggtaaggttggggatcaatacgcaggtgtaattaagaaagagattcaacgtcgtttcttaaaagatccaaattttgcaggaaaggtttgtcgtattaaaattcaattaggtcgagatggcacaatcttggggtatcaaaaaatttcaggctctgatgatatttgttcagctgcattaagtgcggtggctagaacgaaaaaagttccagctgcgccatcagatgaaatttatgaaaaatataaatcaccaattattgactttgatattcgataa

SEQ ID NO: 47 - DNA, 1689 bp, Haemophilus influenzae
atggaaaaaatttggtttcaaaattatccagaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttacgggctggcttaattgcagtaaatgtcaatcctctttatactccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaatttcgtcgtaaaatatgtgaaaaaactcgtgccgaaatataaattaccgcacgcagtaacattccgtgaagtattgagtattggtaaatatcgccaatatgttcgtccagaaatatcgcgtgaggatttagcctttttacaatatactggcggtacaactggcgtggcgaaaggtgcaatgctgacacacggaaatattataaccaatgtcttccaagctaaatggattgcagagccatttattggcgatcattctcgcactcgttcagctattttagccttgcctctttatcacgtatttgccttaacggtaaactgcttattatttttagagttaggtatcacggcgattttaattactaatccgagagatattgaaggatttgtgaaagagttgaaaaaataccgttttgaagcaatcactggtgtaaataccttatttaatgccttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggagtgttcgccattaatcgccgcttgtccaattaatgttgtgaaacataatggcactattggtgtgccagtgccaaatacggatataaaaatcattaaagatgatggctctgatgcaaaaattggcgaagctggcgaattatgggtgaaaggcgatcaagtaatgcgaggttattggcaacgacctgaagcaacgagtgaagtgttaaaagacggttggatggcaactggcgatattgtcattatggatgaatcatatagcttacgcattgtggatcgtaaaaaagatataattttggtttctggctttaatgtctatccaaatgaaattgaagatgtcgttatgctgaattacaaagtgtctgaggctgtggcaattggtattcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactgccaaaaaccaatgttggcaagattttacgtcgggttttacgcgatgaagagatcgcaaaacgtccaaaacattaa

SEQ ID NO: 48 - DNA, 1377 bp, Haemophilus influenzae
atgaaaaaatttaatcaatctctattagcaactgcaatgttgttggctgcaggtggtgcaaatgcggcagcgtttcaattggcggaagtttctacttctgggcttggtcgtgcctatgcgggtgaagcggcgattgcagataatgcttctgtggtggcaactaacccagctttgatgagtttatttaaaacggcacagttttccacaggtggcgtttatgttgattctagaattaatatgaatggtgatgtaaattcttatgctacaataacatcagcaagtagtggagtgagaacaataaagcacggctcagcttcacagcgtaatgttgttcccggtgcttttgtgccaaatctttatttcgttgcaccagtgaatgataaattcgcgctgggtgcaggaatgaatgtcaatttcggtctaaaaagtgaatatgacgatagttatgatgctggtgtgtttggtggaaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaa

SEQ ID NO: 49 - DNA, 1293 bp, Haemophilus influenzae
atggatttactttcagacattgaaaaacaactccaaaaagccaccgctcaagggtttcttatcgccttgagtggtggtttagattccactgtacttctttctttatttgcaaaactttgtcaaaaacaaccgcacttaccgcctttatcggtacgagcaatccacattcatcacggcttaagccccaatgcagatagttgggctaaacactgccaaaacttgtgcgatcaatttcaaattccattgattatcgagcgagtacaagtagataaaaccaatggcattgaagcaggggcgcgtgaagcacgctatcaagccataaaaaaacatcttcaaatacaagaaatgttagttacagcgcatcatctaaacgatcaaacagaaacatttttcttagccctaaaacgtggcagtgggctacaaggcttaagcgcaatgcaacaacaaagtgtattattcggaatgccaatttttcgccctttgttaggttttactcgcccacagttagaagattatgcgcaacaagaaaagctcaactgggttacagatgaaagtaatgaggataatcgatacgatcgtaatttcttacgcaatgaaattttgccaaaattacgtgaacgctgggcgcattttgatttagccgtacaacgttccgcacaacattgttttgagcaacaacagttaattaatgatttattgagcgaaatttttacagaacattgtcaaattaaaaaccaatttaaactgctccaatttcgccaatattctctcgcaaaacagaccgcacttttgcgtatgtggcttgccaaaaaccaacttgaaatgccaagtaaacgccagcttacacagcttattaatgatgtcatttttgcaaaagaagaggcaaatcctcaatttcagcttgtaaataaagttattcgacgttatcaagatagtttatatttaactaagccgttttctgatctaaccaaatgcaccctaaaattagaacaaaacatgctaaatttacccgatgatttaggcaatctcactgttcacgaaaatgaacataatctgattttctactggcaggattactctgttacgctggaaaaaacgaacttgcctatttctattcgttttggctattcgggcaaagtgaaacatcatccgaaacgcccaagagaagatataaaaaaaatctggcaagaattaagcgtaccaccttgggaacgaaatcggatccctttaattttttatggcaatgagctaaaaagtgcggtcggttttttccgtgtttttgacgaatattaa

SEQ ID NO: 50 - DNA, 786 bp, Haemophilus influenzae
atgtttgaaattttatttcctgcccttttaacaggcattgtgctttcgcttattaccgcgccacttggcgtatttgtggtgtggcgtaaaatggcttattttggcgacaccctttctcattctgccttgctcggtgtagcattaggtattttcttacaagtcaatccttacattgcgattgtggtgcttaccttaattcttgctatcgcaatggtgtggttagaaagcaatacgcaattttctattgataccttgctcggcattatcgcccatagctgtttatctcttggcgttgtgacagtaggattattacggaatgtacgggtagatttaatgaattatttatttggggatttactcgcaattaattatacggatttaatttatatcgggattggcgtaataattgtgctttcaacattaatttacttttggcaatccttactttccaccaccgtatcgccagaactcgcacaagttgaaggcattaatatcaaaaaaatgcgttttattttaatgatattaaccgcattgacgattgccttgagtatgaaatttgtcggtgcattaattatcacatccttattaatcattcctgcggcaaccgctcgtcgctttgcgagaacgccagaatctatggtgggctgggcgattattatgagtatgttatcgattataggtggattaatattatcagccttttatgatactgctgctgggccttctgttgtgatttgttctgcgtttttatttgtcttatcactcttcaaaaaagagcgattataa

SEQ ID NO: 51 - DNA, 1428 bp, Haemophilus influenzae
atgccagtgcaacacgtaaaattagctcgagatagacgaaaaaaacgcacatatataaaagtaggcgtgttttttgttgctattctgcttattttgacaggcattttacttacaataaaagacaaatctgaagaaaatcccatattttccacctctgacagtggggaatatcacgagttaaatacatcgccaaataaaaattccaccgcacttcaacctgatgaagatgccacctcttatgatgatgaactgcaagcaaaagatgatgaagttgatgaagtaaaactatcttcagatgatctcggtactttacctcaacacgcacaagacgcactcaatggtttattagacgcggccgatcaagccataagaattactgatcaatttagctatacggtaaccgaaggggatacgttaaaagatgttttagttttatctggtttagatgattcatcagtacaaccgttgattaagcttgatcccgaattagcccacttaaaagcaggtcagcaattttactggattttaaataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaacaaggtcttgatacgcgacaaattagccaacttagtaacgccttacaatggcaagtgagtttacgaaaactaaaaaaaggcactcaatttgccattttagtttctcgtgaatatttaggcgataaacttacaggtcaaggtaatgttgaagcgttacgtatttcatctggtggtaaaaattattatgcagtgcaagcggcaaatggtcgttattataatcagcaaggggaaactttaggcaaaggttttgctcgttatccattgcagcgacaagcgcgagtttcctccccttttaatccaaatcgtcgccatccagtaacaggacgtgttcgtccccataaaggcgtggatttctctgtttctcaaggcacaccagttattgcaccagcagatggtacagttgaaaaggtcgcttatcaggctggcggtgctgggcgttatgttatgttgcgtcacgggcgtgaatatcaaactgtttatatgcacttgagcaaatccttagtaaaagcagggcaaaccgttaaaaaaggcgaacgtattgcgctttctggtaacacgggcatttctacggggccgcatttacattatgaatttcgtattaacggtcgagcagtgaatcctcttactgttaaattacccggtactagcagtggtatgacttcagctgaacggaaacaattccttgttcgtgttcgtgaagctgaaaaaatgttaaaaccttag

SEQ ID NO: 52 - DNA, 2595 bp, Haemophilus influenzae
atgcggatcgcaaaattaatattaaacaccctattaactttatgtattttaggtttagtggctggcggaatgttgtatttccacctaaaatcggaattgccctcagtagaaacattaagaaccgttgaattacaacaaccaatgcagatttatacggctgacggtaaattaattggcgaagtgggcgagcaacgccgtattccagtgaaattagccgatgtgccacaacgcttaattgacgcatttttagcaacggaagacaatcgtttttacgatcatcacggattagaccctatcggcattgctcgtgcattgtttgtcgcagtgagtaatggcggtgcatcacaaggtgcaagtacgattactcaacaattagcgcgtaactttttcttaaccccagaaaaaaccattattcgtaaagcccgtgaagcggtgcttgcggtagaaattgaaaataccctcaacaaacaagaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcggcagcattagaaaaaggcttaacgctttctagtgtattacaagacagcccgatttctattcaaaaaccgggacaaaaaatgtggcaaccgaaaaactcgcctgatcgttatgatggcccgatgcgtttacgcgtaggattaggtcaatccaaaaatatgattgctattcgtgcgatccaaacagcaggtattgatttcacagcagaatttttacaacgttttggttttaaacgtgatcaatattttgctagcgaagccttagcacttggcgcagcctctttcacaccattagaaatggcgcgagcttatgcggtgtttgataatggcggtttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtgcctgaactgccagaattacaatcaaatttcaccgcacttaaagaagatgcgattgatttaatggctgctgcaaaaaatgcctcgtcgaaaatagaatatgcgccacgtgtcattagtggcgaacttgcttttctcattcgtagtgccttaaatacggcaatttatggcgaacaaggtttagactggaaaggcaccagctggcgcattgcacaaagtattaaacgtagcgatataggcggtaaaacaggtactaccaacagttcaaaagtggcttggtatgcgggatttggtgcaaacttagtcactacaacttatgttgggtttgatgataacaaacgagtacttgggcgtggagaagcgggtgcgaaaacagccatgccagcttggatcacttatatgaaaatggctttgagtgataaacctgaacgtaaattgccactgccgccaaaaattgtggaaaaaaacattgatactttgacaggtttgctttctccaaacggtgggcgcaaagaatattttattgtgggaacagaaccgacacgtacctatctttcggaaatgcaagagcgtggttattacgttcctacagagttacagcaacgcttaaataatgaaggcaatacgccagcgacgcaaccacaagaactcttctaa

SEQ ID NO: 53 - DNA, 1671 bp, Haemophilus influenzae
atgaagttatttttaacccaatcagctaatgtaggcgatgcgaaagcctatttattacatgaagtttttcgagcagctgcacaaaaagcaaatgtctctattgtagaaacaccagccgaagcagatcttgttcttgtatttggttctgtattaccaaataaccctgcgttagttggtaaaaaagtctttattatcggcgaagctatcgccatgatttctcctgaagtaacattggcaaatgccttagcgaatggggctgattatgttgcaccgaaaagtgcggtgagttttacaggtgtttctggtgtaaaaaatattgttgcggtaacggcttgtccaactggcgttgcacatacgtttatgtcagccgaagcgattgaagcctatgcgaaaaaacaaggttggaatgtaaaagttgaaacccgtggtcaagttggggctggcaatgaaattactgcagaagaagtcgcggcggctgatttggtatttgttgcagcagatattgacgtgcctttagataaatttaaaggtaaaccaatataccgcacttcaacaggattagccttgaagaaaactgagcaagaatttgataaggcatttaaagaagccaaaatttttgatggtggaaataatgcgggaacgaaagaagaaagccgtgagaaaaaaggtgtgtacaaacacttaatgactggtgtttctcatatgttaccgttagtggttgctggtggattgttgatcgcgatttcctttatgttcagttttaatgtaattgaaaatacaggagtttttcaagatcttcctaatatgttgattaatatcggtagtggtgtggcgttcaagttaatgattgccgtgtttgctggttacgttgcattttctatcgctgatcgtccaggacttgcagttggtttgattgcagggatgctggcaagtgaagcgggtgcagggattcttggcggtattattgcaggtttcttagccggctatgtggtgaaagggctaaatgtgattattcgattgccagcaagcctgacttcattaaaaccgattttaattttaccgctcttgggttcgatgattgttggtttgacgatgatttacctcatcaatccaccagtggctgaaattatgaaagagctaagtaattggcttacttcaatgggcgaagtgaatgcgattgtgttaggcgtaattatcggcgcaatgatgtgtatcgatatgggcggaccagtaaataaagcagcgtacactttttctgttggattgattgcctcccaagtttatacaccaatggctgcggcaatggccgcaggtatggttcctccaattggtatgacagttgcgacttggattgctcgcaataaatttaccgttagccaacgcgatgcggggaaagcatcatttgttcttggtttatgttttatttctgaaggtgcattaccatttgtggcagcagatccaattcgagtcattattagctctgtgattggtggtgcggtggctggtgcgatttcaatgggattaaatattaccttacaagctccgcacggcggattatttgtcattccatttgtatctgagccgttgaaatatcttggtgcaattgcgattggtgctttatcaacaggtgtggtttacgccattattaaatcgaaaaacaatgcggaataa

SEQ ID NO: 54 - DNA, 942 bp, Haemophilus influenzae
atggcaagcgtcgtaaccattaccttaaatgccgcctatgatttagttgggcgtttaaatcgtattcaacttggcgaagtaaatacggtagaaacattgggcttattccctgctggaaaaggcattaatgtcgcaaaagtactaaaagatttaggcgttaatgttgcagtaggcggtttcttgggcaaggataattcagctgatttcgagcaaatgtttaatcagcacggtttgaaagataaattccaccgtgttaatggcaaaacacgtatcaatgtaaaaattaccgagactgaagcggatgtgacagatttaaatttcttgggatatcaaataagcccacaaatttggcaacaatttgtgacggattctttggcttattgtttagattatgacattgtcgcagtttgtggcagtttacctcgaggtgtgtctcctgaattgtttgctgattggttaaatcagcttcatcaagctggcgttaaagtggtgcttgatagtagcaatgctgcgcttaccgctggattaaaagcgaaaccttggctagtaaaacccaatcatcgagaacttgaggcttgggttggtcattcattaaatagtcttgaagaaattattgccgctgcacagcaactcaaagcggaaggcattgaaaacgtgattatttcaatgggcgcaaaaggttctttatggattaataatgaaggcgtgcttaaagccgaaccagcaaaatgtgaaaatgtcgtgagtaccgttggagcaggggattcaatggtagcaggcttaatctatggttttgaaaaaggtttatcgaaaacagaaaccttagcttttgctacggctgtgtccgcttttgcggtatctcagagtaacgtcggtgtgagtgatttgagtttacttgaccccattttagaaaaagtacaaataacgatgattgaaggatag

SEQ ID NO: 55 - DNA, 2124 bp, Haemophilus influenzae
atgaaactcgaagcaagcaagcaagcaagcaagcaagcaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaa

SEQ ID NO: 56 - DNA, 942 bp, Haemophilus influenzae
atgaaaatgaaaaaatttattctaaaatcttttttattggctactttaggttgtgttgcttttacttctatggcacaagcggaggaacgtgttgtcgcgacagtagatggtattcctattttagaaagccaagttcgtgccaatatgggtaaaaaaggcgatcgccaaagtgcacttgataaaattattgatgatcttttagtgcaaaaagcgattcaagaatctggtgtgaaaattgatcctcgtgaaatcgatcgtgttgtggaagacactgcagctagaaatggcttaacttatggtcaatttttggatgcgttagattatcaaggcatttcattaaatacattccgtcagcaaattgccaatcaaatggtgatgggggctgtacgtaacaaagctattcaagaaagtattgatgtaacgcgtgaagaagtggttgcacttggtcaaaaaatgttggatgaggcaaaatcacaaggcactgcacaaaaagttacaggtaaagaatacgaagtgcgtcacattttgttaaaacttaatccattgttaaatgatgctcaagcaaaaaaacaattagctaaaattcgttctgatattattgcaggtaaaacaacttttgctgatgcggctttaaaatattctaaagattatttatcgggtgcgaatggcggtagtttaggttatgcgttcccagaaacttatgcaccacagtttgcgcaaaccgtcatgaaaagtaaacaaggtgtgatttctgcaccatttaaaactgagtttggttggcatattttggaagtaactggcgtacgtgatggcgatcttacagcagaagcctacacacaaaaagcatatgaacgtttagtaaatactcaattacaagatgcgacgaacgattgggttaaagcattgcgtaaaagagcgaatattcagtattttaataaataa

SEQ ID NO: 57 - DNA, 1335 bp, Haemophilus influenzae
atgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaacgaaaaaacgcaaaatgaaaattaaagatgcgttgaaaacgttgattgatgatgaagcagcgaaattaattaaccctgaagaacttaaacaaaaagccattgatgctgtggaacaaaatggtatcgtctttatcgatgaaatcgacaaaatttgtaagaaaggtgaatacagtggtgctgatgtatcgcgtgaaggtgtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctttaa

SEQ ID NO: 58 - DNA, 1482 bp, Haemophilus influenzae
atggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtagatgttggcgcgaagaaagaaatttatcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataa

SEQ ID NO: 59 - DNA, 1254 bp, Haemophilus influenzae
atgagtgtgttaagcagcattttgggaatggtcgtattaatcgctattgccgtgttactttctaataatcgtaaagcgattagtattcgaaccgtagtaggggcgttagcaatccaagtaggatttgccgcccttattttatatgtgccagcaggtaaacaagcgttgggtgccgctgcggatatggtatccaatgttattgcctatggtaatgacgggattaatttcgttttcggcggattggcagatccaagtaaaccatccggtttcatttttgcagtgaaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcgttggtttaattgcattaattaatggtattttaagtggcgtaggcggatggttcggctatggcgacttaaccttacaatctatctttggtttaatttttaaaccattagcatacttaatcggtgtaactgatggtgctgaagcaggtattgcaggacaaatgatcgggatgaaattagcggttaatgaatttgtgggttatcttgaatttgcaaaatatttacaaccagattctgcaattgtattaactgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaa

SEQ ID NO: 60 - DNA, 795 bp, Haemophilus influenzae
atgaaaaaacttacttccattctttctcttattgttctcgttatattagcaatttggcaatattttaccgatacaaccaaaactaaacatcaatcatcctcgcccgtaattgagcagacgaagcaaacaaaagtatctgagcctaaatttgaacctaaattcgagcctcaatttgagacaaagcggacggatattgaaaaaagtgcggtaaaaaatccagatgtttttgcaaactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaataaccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataa

SEQ ID NO: 61 - DNA, 291 bp, Haemophilus influenzae
atgaatattcgtcctttacacgatcgtgtaattattaaacgtgaagaagtcgaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgataccgtaattttcaacgacggttacggcgtgaaagcagaaaaaattgatggtgaagaagtgttaatcatttctgaaaacgatattttggcgattgtggaataa

SEQ ID NO: 62 - DNA, 450 bp, Haemophilus influenzae
atgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataa

SEQ ID NO: 63 - DNA, 948 bp, Haemophilus influenzae
atgaaaaaaatcgcattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagcgcattatatagtgatggcttatttacttttacgttgtttgtctctaatgtaagctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataa

SEQ ID NO: 64 - DNA, 1296 bp, Haemophilus influenzae
atggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttagcagggacttttggatcaatgatgagtccgggttcttctcactcagcaatgattagtgaaatgtcaggattaactatcactcaagtaaacctttcacatgctccatataacatgattgcgggagcaataggtgctgttgttttaaccattcttgcgcttgtttttaaagattatggtgaacaacatcgccaagcttatcttgcagaacaaaaagaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtag

SEQ ID NO: 65 - DNA, 1974 bp, Haemophilus influenzae
atgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgaatgcgaacgtagtaaaagcggggacagaagaaccttatttcacaccttatgtcattcaagaaaaatctgtggtggataataatggcaaaacacataaattaaaaattggttacatcggctttgtgccaccgcaaattatggtttgggataaagcgaaccttcaaggtaaagtggaaacccatgatattgtaaaaacagcgcaaaaatatgtccctgaaatgaagaaaaaaggggctgatattatcgttgcattagctcacacaggcccatctgatgaaccttatcaagaaggtgctgaaaactcagcattctatctagctgatgtaccacatattgacgccgttatttttggtcactcacaccgtttattcccaaataaagaatttgcgaaatcaccaaatgcagacatcgtaaatggtaccgtaaaaggcgtaccagaaagtatggctggttactgggcaaataatatcagcgtggtggatttaggcttaacagaacacaaaggcaaatggattgttacctctggaaaagcagtacttcgtccaatctatgatgctaaaaataaaaaagtgcttgcagaaaatgacccagaaattaccgcacttttaaaaccagttcacgaagctacacgtaagtttgtttctcaacctattggtaaagccacagacaatatgtacagctatcttgcattagtgcaagatgatccaaccatccaaatagtgaaccaagcacaaaaagcgtatgtagaaaaagttgcaccaaatgttgcagcaatggctggcttacctattttaagtgcaggagcgccatttaaagctggtggtcgtaaaaatgaccctacaggttataccgaagtaaataaaggtgaattaactttccgtaatgcggcagacttatatctctatccaaatacattagtcgttgttaaagcaacaggcgaacaattaaaagaatggttagaatgtagtgctggtatgtttaaacaaattgaccctacaagtgataaaccacaatcattaatcgactgggaaggtttccgcacttataactttgatgtgattgatggtgtcaattatgaatatgatctaactaaacctgcacgttatgatggtgaatgtaaattgattaacccagaatcgcatcgtgtagtgaatctcacttatcaaggcaaaccggttgatccaaaagcagaattcttgattgcaacgaataactatcgtgcttacggtaataaattcccaggcactggcgatcaacatattgtttacgcatcaccagatgaaaaccgtcaaattttagctgattacattaaagtaaccagtgaaaaagaaggttctgtaaaccctagcgcggataaaaactggcgttttgtgcctatctcaggtaacgataaattagatgtccgttttgaaacctcaccaagcgaacaagcagctcaattcatcaaagaaaaagcacagtatccaatgaaacaagtgggtacagatgaagttggatttgctgtataccaaattgatttatctaagtaa

SEQ ID NO: 66 - DNA, 375 bp, Haemophilus influenzae
atggcaactatcaaccagctagtacgcaaaccgcgtgtgaaaaaggttgtaaaaagcaacgttcctgcattagaggcttgcccgcagaaacgtggtgtatgtactcgtgtatatactacaactcctaaaaaaccaaactcagcgttacgtaaagtatgtcgtatccgcttaactaacggttttgaagtaacttcttatattggtggtgaaggtcacaaccttcaagagcacagtgttgtattaatccgtggtggtcgtgttaaagacttaccgggtgtgcgttaccacacagtacgcggtgcattagactgtgcaggcgttaaagatcgtaaacaaggtcgttctaaatacggcgttaaacgtcctaaagcttaa

SEQ ID NO: 67 - DNA, 1371 bp, Haemophilus influenzae
atgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaatag

SEQ ID NO: 68 - DNA, 1917 bp, Haemophilus influenzae
atgattgtatttagtaatctgtccttaaaacgagggcaaacggagcttctcgaaaatgcttctgctaccattaatcctaagcaaaaagtcggcttggtggggaaaaatggttgtggaaaatcttcgctttttgccttattaaaaaaagaattaacgccagagggcggcgaggtaaattatccagcaaattggcgggtatcttgggtgaatcaagaaacgcctgcattggatatttctgcaattgattatgtaattcaaggggatcgtgaatattgccgtttgcaacaagagcttgaacaagcaaatgaatgcaatgacggtaacgccattgcacgtattcacgggcaattagaaaccttggatgcgtggacaattcaatctcgtgccgcttcgttattgaatggtttaggatttagtcaagaagaaacaacccagccagtgaaagccttttcgggcggttggcggatccgtttgaatttggcacaagctctgctttgtccatcagatttattattactggatgagccaaccaaccatttggatttggatgcggttatttggttagagcgttggctagtacaatatcaaggcaccttggtattaatttctcacgatcgtgattttctcgatccgattgtgacaaaaatcctccatatcgaaaatcagaagctcaacgaatacacgggcgattattcttcctttgaagtgcaacgagccactaaattggcacaacaaacagcgatgtatcgtcagcaacaacaaaagatttcccatttacaaaaatatattgatcgctttaaagccaaagccactaaagccaaacaggcacaaagccgtatgaaagcactagaaagaatggagctgattgcaccagcttatgtggataatccttttacttttaaatttcgtccaccgcaatccttgccgaatcccttagtgatgattgaacaggcaagtgcaggttatggcagcggagaaagtgcggtagaaattttaagtaaaattaaactgaatttagtgccaggttcgcgcattggtttactcgggaaaaatggtgcaggaaaatcaaccttgattaaacttttagcgggagaactgaccgcactttcaggcacagtgcagttggcaaaaggcgtgcagcttggctattttgctcagcatcaattagatactttacgcgcagacgaatctgctctgtggcatatgcaaaaactcgcaccagaacaaacggagcaacaagttcgagattatttaggcagttttgcgtttcacggcgataaagtaaatcaagcagtgaaatctttttctggaggagaaaaagctcgtttggtgttggctttgattgtttggcaacgcccgaatttattactacttgatgaaccgactaaccatttggatttggatatgcgtcaagcattaacggaagcattggtagattacgaaggttctttggtggtggtgtcgcacgatcgtcatttattacgcaataccgtggaagaattttatttagttcacgataaaaaagtggaagaatttaaaggcgatttagaagactatcaaaaatggctgaatgaacaaaatagcacatctgaaaataaagtttcggaaaaagtgggcgataatgaaaattcggttcaaaatcgtaaggaacaaaaacgccgtgaagcagagttacgccaacaaactgcaccattacgtaaaaaaatcacgcaattagaagaaaaaatgaataaattttcttctgagcttgcgaacatagaaaatcaactggcagatactgaattatataatgcggaaaataaagaaaaattgaccgcacttttggctcaacaagtggatgtgaagaaagcattagatgatgtagaaacggaatggatgactgcacaggaagaattggaagaaatgcttcaagcgtaa

SEQ ID NO: 69 - DNA, 2979 bp, Haemophilus influenzae
atgggattaaatatgaccaattttagattaaacgtgcttgcctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaaaatagtgatacaaaaacaccaccaaaaattgctgaaacggtaaaaacggctaaaacgctggaaagagaacaagcaaacaatattaaagacatcgttaaatacgagacgggcgttactgttgttgaagctgggcgttttgggcaaagcggttttgccattcgtggtgtagatgaaaaccgtgtagcgattaatattgatggattacgtcaagctgaaaccctatcttctcaaggctttaaagagctttttgagggttatggtaacttcaataatacgcgtaatggtgcagaaattgaaactttaaaagaagtaaatattacaaaaggggcaaattcaatcaaaagtggtagtggttccttaggtggatctgtaatttataaaacaaaagatgcgagagattatctccttaacaaggattactatgtaagctacaaaaagggatacgctacagaaaataatcaatcattcaatacccttactcttgcaggacgttataaaaagtttgatgccttagtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaattaacagatgggaaaataacacgtcgagatggttcagaacttcaatttgaaaaaaaagataaaaatattgataacaacatctatgacttcgataaatttattgatactgatgatcgagtaatagaaggtaaactaggcctaaggagatcctctggaacttggtatgattgttcaatatttgattgtaaagataaaacaaaaatgaaaatttttgaaactgaacatccttatggctatggcactactggaacgtggaaaaaagactttgaacttgaaataaaaaaattaaatgacaaaaatttcgctagagtaaaggatgcgaataataaaacatactctattcttccctcatctccaggttatttagaacgcctctggcaagagcgagatttagacaccaacacccaacaattaaatttagatttaaccaaagacttcaaaacttggcgtgttgaacataatctacaatatggtagctcatataatacaacgatgaagcgaatggttaatcgtgctggtaatgatgcttctgatgtgcaatggtgggcagagcctacacttggttacagtttgttgtatgataaacctcacacttgtaaaaccgcttatggggggtggaaagctaacctttgccctcgagttgatcctaaattttcattcttattacccattaaaacaaaagaaaaatcagtctatctctttgataatgttgttataactgattatttatcttttgatttgggttatcgttatgacaatatccattatcaaccaaaatataaacacggcgttacaccgaaattacctgatgatattgtgaaaggattgtttattccattaccaagtggtaaaaataataatgatgatcctgaagttaagaaaaacgtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttttaa

SEQ ID NO: 70 - DNA, 825 bp, Haemophilus influenzae
atgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataa

SEQ ID NO: 71 - DNA, 1218 bp, Haemophilus influenzae
atgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaa

SEQ ID NO: 72 - DNA, 2586 bp, Haemophilus influenzae
atgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcgggatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtggggtaa

SEQ ID NO: 73 - DNA, 1413 bp, Haemophilus influenzae
atggctatcgcattgatttttgactgtggtgcaacaaatttacgcaccattgcgataaatgaaaaaggacaaattcttgcctctcatcaccttgctaataatacaaaacaaggaatcgaatcatctgattatcatatttgggatattgaagaaatctggcaaaaattaatctcttgtgcaactcaaaccttcaatcaattaatacaacaaggcattgatttaaaagatattgtaggaatatctgttaccactttcggcgtggatggcgcaccttttgataaaaatgatcaacaactttatccgattatttcatggaaatgcccacggaccataccagtaatggaaaatctatctaatcaattagatatcaaatctctttatcaacgtaacggcattggtcaatacagttttaatactttatttaaattacattggttaaaaacacacaagccagatgttttccaaaaaatggctaaattcgtttttatttcgtcaatgctcactcaacgcttaactggtcaattcactacagatcacacaatggcgggaacatcaatgatgacaaaccttactagcggtaattgggatccatcgattttagcatcgctgggtttaagtaataaccatttccctcctatgcgttatgcaggtgaaaaagttggaaaattacgtacaccgttagcccagaaatggggattaaatcccgtacctgtcatttcttgtggacatgatactcaatttgctgtgtttgggtctggtgcagggctgaatcagcctgtgttaagttctggcacctgggaaatcttaatggctagaacccagcacgcagaacctagatttgagtttgtttctcaaggcttaaccactgaatttgatgcacaatccaattgctttaatccagcggtacaatgggtgggttctggcgtcatagaatggttaggtaaattattattttccgatgtttatggtagcgatcactattacaccacaatgatcaaagagggagaaaaagcttttaatgcgggaaaaagagcggtcaattttgaaggtatttttagccaaaaaggacaaggtaatatcagtggactttccatgtttgctactcgtggagaaatttatgtcagcgcattacaacatatggcaaataaactcaaaaacggtttatccgtgctacatcaagtcagtcagttccaagctaaaagcttaatttgtgttgggggtggttcaaaaaatgtattgtggaatcaaatccgtgcaaacaccttaaatttaccgattgatgttgtggacatttctgaaagtactgtacttggtgccgcaatgtttacctttgcaggcgtaggcatttacgaaaatgtaaacgcggcacagcaagcgatgcaaccaacaagaaaacgaatttacccaaactag

SEQ ID NO: 74 - DNA, 1074 bp, Haemophilus influenzae
atgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacgataa

SEQ ID NO: 75 - DNA, 708 bp, Haemophilus influenzae
atgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaaatgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaattaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcatacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaagtaa

SEQ ID NO: 76 - DNA, 435 bp, Haemophilus influenzae
atgcgtttaaatactctatctccggctgaaggtgcaaagcatagtgctaaacgcctcggtcgtggtattggttcaggtttaggcaagactggtggccgcggtcataaaggtcaaaaatctcgtactggtagcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaataa

SEQ ID NO: 77 - DNA, 618 bp, Haemophilus influenzae
atgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataa

SEQ ID NO: 78 - DNA, 2793 bp, Haemophilus influenzae
atggcccaaattgcaacaaatccgcttgtgctagtggatggttcttcttatttatatcgtgcatttcatgcctttccttctttaactaatgccgcaggtgagccaacaaacgcgatgtacggcgtgttaaatatgttaaaacgcctcatctcacaagtacagcccactcatatagccgttgtttttgatgcaaaagggaaaacatttcgcaatgaaatgtttgaacagtataaatctcatcgcccgccaatgcctgatgatttacgcaaacaaattcagcctttgcacgatatgattcgtgcattgggcattccgcttttagtggtggaagggattgaggcagatgatgtgatcggtactctcgcactacaagcatcaagtttgggtaaaaaagtgctcattagtactggcgataaagatatggcacagttggtggatgacaatattatgctcatcaacaccatgaataatagcctattggatcgtgagggtgtgattgaaaaatacggtattccacctgaactcattattgattatctcgcacttatgggcgatagtgcagataacattcctggcgttgctggcgtgggcgaaaaaaccgcacttggtttactacaaggcataggaagcatggctgaaatttatgccaatcttgaaaaagtagcggaactgccaattcgtggggcgaaaaaactaggtgaaaaattattggctgaaaaacccaatgccgatctttcttatacattagcaaccatcaaaacggatgttgaacttaacgtgacaacagatcaattgttgcttggagaaagccaaaaggatcaactcattgaatattttgctcgctacgaatttaaacgctggcttaatgaagtgatgaatggtgctgactccataacccaaaccactgaacagccagtgaaaatgaaccagtatcaggcgacctcacaagatcaaagtgcggtggaaaatacgcctaaaattcaaatcgatcgtacaaaatatgaaaccttactcactcaagcggatttaacgcgctggattgaaaaactcaatacagcaaaactcattgcagtggatactgaaacagatagcctcgattatatgtctgctaatttagtgggtatatcttttgctcttgaaaatggcgaagccgcttatttaccattgcaattggattatttggatgcgccaaaaacactcgaaaaatcgaccgcacttgcggctatcaaacccattttagaaaatcctgacattcacaaaattggacaaaatattaaatttgatgaaagcatttttgcccgtcatggcattgaattacaaggtgttgaatttgatacgatgttgctttcttatacgctaaatagtacgggtcgtcataatatggacgatttagccaaacgttatttaggtcatgaaactatcgcatttgaaagcatcgctggaaaaggaaaaaatcagcttacgtttaatcaaattccattagaacaagccactgaatacgcagcagaagatgcggatgtgacaatgaaattacaacaagcactgtggttgaaattgcaacaagaaccaacgcttgttgaattgtataaaacaatggaattaccattacttcatgtgctttctcgcatggaacgtacaggcgttttgattgatagtaatgccctctttatgcaatctaacgaaattgccacaagattaaccgcacttgaagaacaagcttacgaattagcaggtcagccatttaatttggcttccaccaaacaattacaagaaattttgttcgataaacttggcctacctattttacaaaaaacgccaaaaggtgcgccatcaacgaatgaagaagtattggaagaattagcctatagccacgaattacccaaaattttggtcgaacatcgtgggttgagcaaacttaaatccacttacacggataaactgcctcaaatggtcaactcacaaacgggacgagtgcatacctcttatcatcaagcggtgacagcgacaggacgtttatcatcaagtgatccaaacttacaaaatatcccgattcggaatgaagaaggtcgtcgtattcgacaagcatttatcgcacgtgaaggttattctattgtcgctgctgactattctcaaattgagctacgcattatggcacatctttctggcgatcaaggcttaattaacgccttctctcaaggcaaggatattcatcgctccacggctgctgaaatcttcggtgtatcattagatgaagtcaccagcgagcaacgtcgcaatgctaaagcgattaatttcggcttaatttatgggatgtccgcgtttggactttcacgccaacttgatatttctcgtcctgatgcaaaaaaatacatggatttatatttccaacgctatccgagtgtacagcaatttatgaccgatatccgtgaaaaagcgaaagcacaaggctatgtggaaacgttatttggtcgccgtttatatttacctgatatcaattctagcaacgcaatgcgtcgtaaaggggcagaacgcgtagcgataaatgcaccgatgcaaggcacagctgcggatattattaaacgagcgatgattaaacttgatgaagtaatctatcacgatcccgacattgaaatgattatgcaagtacacgatgaattagtgtttgaagtgcggtcagaaaaagtcgagtttttccgtgaacaaattaaacaacaaatggaagatgcatcggaattagttgttccgttgatcgtagaagtcggtgtaggtcaaaattgggatgaagcgcattaa

SEQ ID NO: 79 - DNA, 2571 bp, Haemophilus influenzae
atgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggctatgtcggctatgaagaaggcggttatttaactgaggctgttcgtcgtcgtccatattcagtgatcttattagatgaagttgaaaaagcccatgcggatgtattcaatatcttattacaagtattggatgatggtcgtttaactgacgggcaaggtcgtactgtggacttccgtaatacggtggtaattatgacctctaacttgggttctgatttaatccaaggtaacaaagacgaaagctatagcgaaatgaaagccttagtgatgtcagtggtaagccaacatttccgtcccgaattcatcaaccgtattgacgaaactgtggtattccatccgcttggtaaagagaatattcgtgcgattgcaagtatccaattagaacgcttagcaaaacgtatggaaactcgtggctatgaattagtgtttaccgacgctttattagatttcattggtgaagtggggtatgacccaatttatggtgcacgtccattgaaacgtgctattcaacaagagatcgaaaacagcttggcacaacaaattctatctggtgcgttattacctggtaaggttgttaccattgattacgccaacgcagaagttcaagctagacaatag

SEQ ID NO: 80 - DNA, 2349 bp, Haemophilus influenzae
atgacaaaaaaacgtaaaaacttaatcagccaagatcctcattacaaacgagaattggaaaaatacggcaatccaatcccgagccgtgaatttattttaagcgttattcgagacaataatgcaccgatgaatcgggatgaaattttgaccgcactttccattcgaaatgaagagcaaatagaagcgatgcgtcgccgattacgcgcgatggaaaatgatggccaattagtgttcaccaaacgtaaacgctatgccttaccagaaaaattagatttatttaaaggcacggtaattggtcatcgcgaaggttttggttttttacaggtcgatggcaaaaaggatgatttattcattccaaaccatcaaatgcaaagagtcatgcatggagattttgtcttagcgcaacttgctggattagatcgtcgtggtcgccgtgaagtgcgaattgtgcgcgtattagaaagccgtaaaaaacaaattgtgggtcgttttttcttagaaaacggttttagctatgtggtgcctgatgacagcagaattggtcgagatattctcgtgccaaatgaacatcgtaatggtgctcgcatgggacaagttgtggttgtcgagttgcaagaacgttctgccagttttaaccagccaattggcgtaatcacagagatcctaggcgataatatggcgaaagaaatggaagtggaaatcgccttgcgtaaccacgatattccccataagtttccaagtgcggtggaaaaatacgtaaaaaaattcactgaagaagtgcctgaagaagcaaaaaaaggccgtgtggatttacgaaatttaccgcttgtgaccattgatggtgaagatgcgcgggattttgacgatgccgtttattgtgaaaaacacggcaaaggctggaaactttgggtggcgattgcggatgttagttattacgtacgtttacgttccgctttggatgtggaagcgcataatcgtggtaactcggtctattttccgaaccgagttgtacctatgctacccgaaattttatcgaacggcttatgctctctaaacccacaagtggatcgtttgtgtatggtgtgtgagatgcaaatttctgccaaaggtaagctcatagattatcgcttttatgaagcagtgatgaattctcacgcccgcctcacttatacaaaagtagcaaaaatgcttgaaggcgatgaagaattacgcgctcgttattctacgcttgtgcctcatttagaagatctttataaactctatcaagcgttgcttggtgcacgtcatcaacgtggtgcgatcgattttgaaaccattgaaactaagtttatttttaatgcaatggggagaattgagcgtattgaacccgttgttcgcaatgatgcccacaaaatcattgaggaatgtatgattcttgcgaatatcgcagcagctaattttatggaaaaacataaagaacctgcattatatcgcattcatgccaccccgagcgaagaaaaattaacatcgttccgcactttcttaagtgagtttggtttaaccttagaaggtggattgaagccaaccacaaaagactatgctgctctcttagaaaaagttaaagaacgacatgatcatgaacttattcaaacaatgttgctacgttcattaagtcaagccgtctatcatgctgataatattgggcattttggtttggctttggaagaatatgcacactttacttcgccaattcgccgttatccagacttaacacttcatcgaggtatcaagtatttactcgctaaagaacaaggcgcaaaacgtaaaaccaccgatacaggcggttatcattactcttttgatgaaatggatttacttggcaatcactgttcaatgacggaacgccgtgccgacgacgccactcgtgaagtggcagattggctgaaatgcgaatatatgcaagatcatgttggcggtgaatttagcggtgttatttcatctgtgactggatttggtttatttgtacgcttagatgatttattcatcgatggtttagtccatatttccaccttagaaaacgattattaccaattcgatgcagcaaaacagcgtttaattggcgaaaatagcggaatgcaatatcgcttaggcgataaagttcgtatcaaagttgaagcagtacatttagaaaataaaatggtcgatttctcgctgatggggagtgaacgtaaacctcgtcgtgctggaaaaacggcgaaagaaaaagccaagaaagtctttaaagaactaccgtctaaaacatcccagaaacgaaaaagtgcggtaaaaaagaaagatgttttgaagaaagcatctagaaaacgaaaataa

SEQ ID NO: 81 - DNA, 981 bp, Haemophilus influenzae
atgaacggtacaatatgtccaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaggatcattattttcttggtaagaaaataaaaaaggtattttttaattgttctgtaatttttgaacaatactatacgtttatgcaattaattaaaaataatgaatatgaatatgctgatattattttatcatcttttctaaatttaggggattcagaattaaagaaaatccagcgtttagaaaaattactaccacaaatcgatcttggtcatagctatttaaaaaaactacgagcttttgatgctcatttacaatatcacgaactatatgagaataagaggattacatcaggcgtctatatgtgtgcagtggcaactgcaatgggttataaagatctttatttgacaggcattgatttttatcaagaaaaagggaatccttacgcatttcatcatcaaacagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattatttccctttatcaccactgaataacccaattacttttattctcgaagaaaagaaaaattacacacaagatattttaattccgccgaagtttgtatataaaaaaattggtatatattccaaaccaagaatttaccaaaatctgatttttcggttgatctgggatatattacgtttacctaatgatataaaacacgctttgaaagcaaagaaaatgagactacgtaaataa

SEQ ID NO: 82 - DNA, 1740 bp, Haemophilus influenzae
atgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaa

SEQ ID NO: 83 - DNA, 1197 bp, Haemophilus influenzae
atgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactttaa

SEQ ID NO: 84 - DNA, 1173 bp, Haemophilus influenzae
atgacgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtacctgtgcgaattaaattagatccacaacaatttacagaaacgccattgagaattggtctttctgcaacggcaaaagtaagaatttcagattcatcaggcgcaatgctacgagaaaaaacagaaccgaaaacgttattttctactgatacacttaaatatgatgaaagtgcggtagaaaatttgattgaatctatcattcagcaaaacagccattaa

SEQ ID NO: 85 - DNA, 594 bp, Haemophilus influenzae
atgaaaaacatcgcaaaagtaaccgcacttgctttaggtattgcacttgcttcaggctatgcttccgctgaagaaaaaattgctttcattaatgcaggttatatttttcaacatcacccagatcgccaagcagtagcagataaacttgatgctgaatttaaacctgtagctgagaaattagcagcaagcaaaaaagaagttgatgataaaattgctgctgctcgtaaaaaagtagaagcaaaagttgcggctttagaaaaagatgcacctcgcttacgtcaagctgatattcaaaaacgccaacaggaaattaataaattaggtgcggctgaagatgctgaattacaaaaactaatgcaagaacaagataaaaaagttcaagaattccaagctcaaaatgaaaaacgtcaagctgaagaacgtggtaaattattagatagcattcaaactgcgacaaataatttagcaaaagcaaaaggttatacttatgtgcttgatgcaaattcagttgtatttgcggtagagggtaaagatattactgaagaagtattaaaatctatccctgcttctgaaaaagcacaagagaaaaaataa

SEQ ID NO: 86 - DNA, 2403 bp, Haemophilus influenzae
atgaaaaaacttctaatcgcaagtttattattcggtacgacaacgactgtgtttgccgcaccttttgtggcaaaagatattcgtgtggatggtgttcaaggtgacttaaaacaacaaatccgagcaagtttacctgttcgtgccggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagaacactatgcaagtgtaggtcgctataacgcaaccgttgaacctattgtcaatacgctaccaaataatcgcgctgaaattttaattcaaatcaatgaagatgataaagcaaaattggcatcattaactttcaaggggaacgaatctgttagtagcagtacattacaagaacaaatggaattacaacctgattcttggtggaaattatggggaaataaatttgaaggtgcgcaattcgagaaagatttgcagtcaattcgtgattattatttaaataatggctatgccaaagcacaaattactaaaacggatgttcagctaaatgatgaaaaaacaaaagttaatgtaaccattgatgtaaatgaaggtttacagtatgaccttcgtagtgcacgcattataggtaatctgggaggtatgtctgccgagcttgaacctttactttcagcattacatttaaatgatactttccgccgtagtgatattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaattgatcctatcaatggtagcaatgatgaagtggatgtcgtatataaagtcaaagaacgtaacacgggtagtatcaactttggtattggttacggtacagagagtggtattagttatcaagcaagtgttaaacaagataatttcttaggaacaggggctgcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaataactcctattatgtaggattaggccatacctataataaaattagtaactttgctctagaatataaccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagatgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgccgctcaaaatggtaatagtaatagtaatagtaatggtacttttaataagataagttctgatgtgattggtggtaatgcaatcacaactgcgagtgcagaacttattgtaccaacaccgtttgtgagcgataagagccaaaatacggtccgaacttccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttctaa

SEQ ID NO: 87 - DNA, 1332 bp, Haemophilus influenzae
atgtcatttttgtggtcactaggttcttttatcattgcgattgctgtattagtatccgttcacgaatatggtcacttttgggcagcgagaaagtgcggtataaaagtccatcgtttttccattggttttggaaaagtaatttggaaacgcattgacaaatatggtacagaatttgcggtttcaatgattcctttaggcggctatgtaaaaatgcttgatggacgtaatgaagtagttcctgctgagcaaaaatcacaagcatttgacagtaaaagcgtattacaacgcgcatttgtaattattgcaggccctttagctaattttatttttgcaatttttgcttattggatcatctacctttatggaatgccaacggttaaaccagtgattcaatcaataacaccaagttccatcgcagcacaagctcacattgaacctaatacacaaattctagcggttgatggcgaagaaactcaagattgggaaaccatcaatatgctacttgccacaaaaatgggtgagcctaatgttgaaattaccctttctcctttcaattctaatattgaacaacaacggactttaaatcttacaaattggatattcgatcctgaaaaagaaagtgcttttgaggcattagggattatgcctatgcgccctaaaattgaaatggtgctttctaaagttgttcaaaattctcccgctgagaaagctggtttacaaatcggtgataaaattttaaaagaaaatttaaccgcacttccttggcaagattttataaaacaggtcgaacaaggcgaatctttttctattaaagttgaacgtaatggagaaacatttgacaaagtcctaactccagtgcgtaatcaaaatggcaaatggtttgttggggttagcccaaccttgacaaaattagcggatgaataccgtactgaattaaaatatggtattcttgaatctttacaaaaaggcattgaaaaaacagggcagctttcccttttaaccttgaaaatattagggaaattacttactggcgatttgtcattaaataatttaagtgggccaatttctattgcaaaaggtgctggtgcatcagcaaatattggattggtgtattttttaagttttatggcattgattagtgtaaatttagggattatgaatttatttccattaccagtattagatggcggtcatttagtttttttaacaatggaagctgttaaaggaaaacctgtttctgagcgggtgcaaagcatctgttatcgaattggcgcagcactgttattaagcttaacggtgtttgcattatttaatgattttttacgtctataa

SEQ ID NO: 88 - DNA, 2169 bp, Haemophilus influenzae
atgacaacccaaaacttccttgtagaaatcggcacagaagagctgccaccaaaagctctcaaaacattagcgacctcttttgcggataacgttgaggcggaattgaatcaagcaggtttatcattcgataaaatcgaatggtttgcggcaccgcgtcgtttagccgtaaaagtgttgaacttagcaacccaacaaccgagcaaagaaatcgaaaaacgagggcctgcagtatcagccgcctttgatgcggaaggtaaaccaactaaagcggcagaaggctgggcgcgtggttgtggcattactgttgagcaagcagaacgcattgcaactgataaaggcgaatggctcgttcaccgtacaaaaattaaaggtcagccgaccaaaaacttacttaacgatattgtggcaaatgcgttagcgaaattgccaattccaaaaccaatgcgttgggcagataaaaccgtgcaatttatccgcccagttcacactgtgactatgttgttaggtgatgagttaatcgaaggcgaaattttaggtgtggcaagtgctcgcaccattcgcggtcaccgcttcttaggcgagaaagaatttgacattcaacatgcagaccaatatccgcaattattgcgtgataaaggttctgtggtggcagatttcaatgagcgtaaagcagaaattttggcaaaatctcaagcaaaagcgaccgcacttggtggcgtggctgacattgaagaaagcctgcttgaagaagtcacttccttggtggaatatccaaatgttttagcggcaaaatttgaagaacgcttcttagcggtgcctgcggaagccttggtttacaccatgaaaggagaccaaaaatatttcccgatttatgataaagacggcagattattaccgcactttatctttgtctcgaacatcaacccagaagatccaaccgcgattatcgaagggaacgaaaaagtggttcgtccacgtttaaccgatgcggaattcttcttcaaaaccgacttaaaacaaaaactggttgatcgtttaccacgtttagaaaccgtgttgttccaacaacaacttggcacattgaaagacaaaactgaccgcattgaacaacttgcaggcgaaattgcaaaacaaatcggcgcagatgaagcgaaagcaaaacgtgcgggtttactgtcaaaatgtgatttgatgaccaacatggtattcgaattcactgatacgcaaggcgtaatgggtatgcattatgctcgtcacgacggtgaagatgaagaagtggcagtggcgttaaacgaacaatatatgccacgctttgcgggtgatgaattacctaagtctttagtggcaagtgcggtcgctttagcggataaatttgacaccttaacgggtatcttcggcatcggccaagcaccaaaaggtagcgcagacccatttgcattacgtcgtgcggcattaggtgcattacgtattatcgttgagaaaaatttgcctcttgatctgaatgacattattagcaaagcatttgatttatataaagaacttgataacgaaagactacgtaatgcacctattgccaaaacaagaggtggatttagtgaatacccagaaggttatgtttcattctttacacgtggtgatgatttagttccaaaacaaaaaatccttgatgaggtagtagacttcatgctcggtcgtttccgtgcatggtatcaagatgaaggcattgcggtggatgtaattcaagcggtattggcacgtcgtccaactcgccctgctgattttgatgcgcgcgtgcgtgcggtttcacacttccgtactttagattcagcggaagcgttagcagcagcaaataaacgtgttagcaacatcttagcgaaagcaggtgcggcaattggcgagatcaatttaaccgcttgcgtagagccagcagaaaaagcccttgctgaagcggtactggcattacgcactgaagtacaaccgcttatcgcacaaggcgattacaccgcagtattggataaattagcaaacttacgtgcgccagtagacagtttctttgataacgtgatggtaaatgctgaagatccagcactacgccaaaaccgattagcgattttaaatacgttacaagggttattcttacaagtagctgatatttcagtgcttcaataa

SEQ ID NO: 89 - DNA, 417 bp, Haemophilus influenzae
atgacattacagaaatttttgttacccccattattatttttatcaataaatacctttgcagcaccagcatatttgctttttggtggagataatcatgataaatttttaggctgtttgaactgtagtaaacatgataactcatcaatttggaataaatatggtgaattcggctctaaatataatagcgatagtatttggaataaatacggaacttatggctctaagtataacagtgaaagtccttggaataagtattctacaagtgggccagtgattgttgataatgaaggtaacttttatggtaaattcacaactaataagtatgataatcagacaagaattaaatctcttctttggattttagaaaatcatgaatatattattgaaaatattaatgatgtgatagataaaatgtaa

SEQ ID NO: 90 - DNA, 450 bp, Haemophilus influenzae
atgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaa

SEQ ID NO: 91 - DNA, 456 bp, Haemophilus influenzae
atgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataa

SEQ ID NO: 92 - DNA, 1347 bp, Haemophilus influenzae
atgttagaaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctatcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataa

SEQ ID NO: 93 - DNA, 1548 bp, Haemophilus influenzae
atgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttatctcgagccgtagataaagacattgatgccgcataccaagcattgaaagtggcagaagcattccgtattcatacttttattgcaagctcggcattacacgttgaagcgaaattaaaacgttcttttgatgatgtggtaggaatggcagttgcagcagtgaaacgcgcacgtaattatacggatgatgttgagttctcttgcgaagatgcggggcgtacgggcattgacaatatctgtcgtattgtagaggcggcaattaatgcaggtgcaactacagtaaacattccagataccgttggtttctgcttaccaaatgaatacggcaatattattgctcaagtgcgtaatcgcgtgccgaatatcgacaaagccgtgatttccgtgcattgccacaatgacttaggtatggcaaccgctaattctttaaccgctgtacaaaatggtgcacgccaaattgaatgtactattaatggaattggggaacgtgcgggcaatacttcccttgaagaagtggtaatggcaatgaaagtgcgtcaagatttcatgggcgtggatactcgtattaatacccaagaaattcatcgcgtgagtcaaatggttagccagctttgcaatatgccaattcagccgaataaagccattgtaggctcaaatgcttttgcccattcttctggtattcatcaagatggtatgttgaaaaacaaaaatacctacgaaattatgtctccagaaaccattggtttgaaaaaagaaaaattgaatttaactgcacgttctggtcgtgcggctgtgaaaggtcatatggcggatatgggctacaacgaacaagattatgatttggataaattgtatgacgcgttcttaaaattggcggataaaaaaggtcaagtgtttgattatgatttggaagccttggcatttatcgatatgcaacaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaa

SEQ ID NO: 94 - DNA, 5385 bp, Haemophilus influenzae
atgctaaataaaaaattcaaactcaattttattgcgcttactgtcgcctacgcattaaccccttatacagaagccgcgttagtgagaaacgatgtggattatcaaatatttcgtgattttgcagagaataaagggaagttttctgttggtgcaacaaatgtggaagtgagagataacaaaaataataatttgggcagtgcgctacctaaagatattccgatgattgattttagtgctgtggatgtagataagagaattgccacgttggtaaatccacaatatgttgtgggggtaaaacacgttggtaacggtgtgggtgaactacattttgggaatttaaatgggaattggaaccctaaatttggaaattctattcagcatcgagatgtatcttgggaggaaaacagatattacactgttgaaaaaaataatttttcttctgaattaaacggaaaaacacaaaataacgaaaaagataaacagtatacatctaataaaaaagatgttccttccgaattatatggacaagccttagttaaagaacagcaaaaccaaaaacgccgtgaagattattatatgccacgccttgataaatttgttaccgaagttgcaccgatagaggcttcaactacaagtagtgatgctggaacatataatgatcagaataaatatcctgcttttgtgagattaggaagtggctctcaatttatctataaaaaaggaagccattatgaattaattttagaagagaaaaacgagaaaaaggaaataatacacagatgggatgtaggtggagataatcttaaattagttggtaacgcttatacctatggtattgcaggcacgccttataaagtgaatcatacagacgatggactcattgggtttggtgattcaaccgaagatcataacgatccaaaagagatattatctcgtaaaccgcttactaattatgctgtcttgggagatagtggctcaccgttatttgtttatgataaatctaaagagaaatggcttttccttggtgcttatgatttttggggagggtataagaaaaaatcttggcaagaatggaatatttataaaccacaatttgctgaaaatattctcaaaaaagacagtgctggtttactgaaaggtaatacgcaatataactggacaagcaaaggtaatacaagcttgatatctggaacatctgaatcattaagtgttgatttagtggataataaaaatctcaatcatgggaaaaatgttacgtttgaaggaagtggaaaccttaccttaaataataatatcgatcaaggtgcaggcggattgttctttgaaggtgattatgaagttaaaggcacttcagaaaatacgacttggaaaggggctggtatatctgttgctgaaggaaaaacagtaaagtggaaagtgcataaccctcaatttgatcgtttagctaaaattggtaaaggaaagctaattgttgaaggaagaggagataataaaggttcgctaaaagtgggcgatggcacagttgttttaaaacaacaaacaactacaggacaacacgcttttgcttctgtaggaattgtaagtggtcgctcaactgttgtacttaatgatgataaccaagtagatccaaattcaatttactttggttttagaggcggtcgattagatgccaatggcaataatctcacttttgaacatatccgtaatattgatgatggtgcaagactagttaatcataatatgactaatgcctcaaatataacgattactggagcaggattaattacaaatccaagtcaggtcactatatatacaccagcaataaccgccgatgatgataattattactatgtgccatctattccaagaggaaaagatctttactttagtaatacctgttataaatactatgcgttaaagcaaggtggaagccctactgcagaaatgccttgctatagctctgaaaaatcagatgctaattgggaattcatgggcgacaatcaaaatgatgcacaaaagaaagccatggtgtacatcaataacagacgtatgaatggctttaatggttattttggcgaggaagcaactaaggcagatcaaaacggtaaattaaatgttacctttagtggcaaaagtgatcaaaatcgctttttattgactggcggaacaaaccttaacggtgaattaaaagttgaaaaaggtacattattcctttctggcagaccaacaccacacgcaagagatattgcaaatatttcttcaacagaaaaagataaacactttgctgaaaataatgaagtggtggtagaagacgactggattaaccgcacttttaaagcaacaaatattaatgtaaccaataacgcaaccctttattcaggtcgcaatgttgaaagtattacttcaaatatcacagcctctaataaagcaaaagtgcatatcggctataaagcaggcgataccgtttgtgtacgttctgactatacgggctatgtgacttgccataatgacactttatctacaaaagcactcaatagttttaatccaactaatttgcgcggtaatgtaaatttaaccgaaagtgcaaactttaccttaggcaaagctaacttatttggcacaattaacagcacggaaaatagccaagttaatttaaaagaaaacagccattggtatttaacaggaaatagtgatgttcatcaattagatctagcaaatgggcatattcatttaaataatgtctcagatgcaacaaaagaaacaaaataccacacgctcaatattagcaatttatcaggtaatggttctttctattattgggttgattttaccaaaaatcagggcgacaaagttgttgtaaccaaatcagccaaaggtacctttacattacaagtggcaaataaaacaggcgagccaaatcataatgaacttacgctttttgatgcgtcaaatgcaactgaaagaagtggcttaaatgtttcactggctaatggcaaagttgatcgaggtgcttggagctatactttgaaagaaaatagtggacgttattacttgcataacccagaagtagaaagaagaaatcaaactgtcgatacgccaagtattgcaacagctaataatatgcaagctgatgtacctagcgtatcaaataaccatgaagaaaccgctcgtgttgaagcaccaattccactgccagcaccacctgcacctgctactggatcagcaatggcaaacgagcaaccagaaactcgtcctgcagaaaccgttcaacctacaatggaagatacaaatactactcacccatcgggatctgaaccacaagctgatacaacacaggctgatgatccaaattcagaaagtgttccatcagagacaattgaaaaagtggctgaaaatagtccgcaagaaagtgaaacagtagcgaaaaacgagcaaaaagcaaccgagacaacagctcaaaatgatgaagttgcaaaagaagctaaaccaactgtggaagctaacactcaaacaaatgaactcgcccaaaatggaagcgaaaccgaggaaactcaagaggctgaaactgctcgtcagtctgaaataaattctactgaagaaacagtagtagaagatgatcctacaatcagtgaaccaaagagcagacctagaagaagtattagctcgtcttctaataatataaatctagcaggaacagaagatactgctaaagtagaaacagagaaaactcaagaagcccctcaagtggcttttcaagcgtctccaaaacaagaagaaccagaaatggctaaacagcaagaacagcctaaaactgttcaatcgcaagcacagccagaaactaccacacagcaagcagagcctgctcgtgaaaatgtttcgactgttaataatgtaaaagaagctcaaccgcaagcaaaacctacaactgttgctgcgaaagagacaactgcatcaaacagtgaacagaaagaaactgctcaacctgtagctaatccaaaaacagctgaaaataaagcagaaaatcctcaatcaacagaaacgacagatgaaaatattcatcagcctgaagcccacactgctgttgcttcaacagaagttgttacacctgaaaatgctacaacacctattaaacctgttgagaataaaactacagaagctgaacaacctgtgacagaaaccacaacagtaagcactgaaaaccctgtagtgaaaaatccagagaatacaacacctgctacaactcaatctacggttaattcagaggcagttcaatcagaaacagcgacaacagaagctgttgttagccagtctaaagtgacttctgctgaagaaacaacagtagcttctactcaagaaacaacagtggataattcaggatctactccacaaccacgaagcagaagaactcgtagatcagctcagaatagttacgagccagtggaactacatactgaaaatgcggagaatccgcaatcgggaaatgatgtggctacacaactagtattgcgcgatctcacaagtacaaacaccaatgcggtaatttctgatgccatggcaaaagcacaatttgttgcattaaatgtagggaaagccgtttctcaacatattagccagttagaaatgaataacgaggggcaatataacgtttgggtatctaatacttcaatgaaagaaaattattcctcaagtcaatatcgtcattttagttctaaaagtgcgcaaactcaacttggttgggatcaaacaatctcaagcaatgttcagttaggtggtgtgtttacttatgttcgcaatagtaacaactttgataaggcaagcagtaaaaataccttagcacaagcaaatctctattctaaatattatatggataatcattggtatttagcggtggatttaggctatggtaatttccaaagcaacttacaaactaatcataatgcgaaatttgctcgccatactgcacaatttggtttaaccgcaggcaaagcatttaatcttggcaattttgctgttaaaccaactgtaggggttcgttatagttacttatcaaacgctaattttgcattagctaaagatcgcattaaagtaaatccaatatctgtcaaaacagcctttgctcaagttgatttaagttatacttatcacttaggcgagttttccattacgccaattttgtctgctcgatatgatgcaaatcaaggcagcggcaaaattaatgtagatagatatgattttgcttacaatgtggaaaaccaacagcaatataacgcaggacttaaattgaaatatcataatgtgaaattaagtctaattggcggattaacaaaagcaaaacaagcggaaaaacaaaaaactgcagaagtgaaactaagttttagtttttaa

SEQ ID NO: 95 - DNA, 2739 bp, Haemophilus influenzae
atgactaaaaaaccctattttcgcctaagtattatttcttgtcttttaatttcatgctatgtaaaagcagaaactcaaagtataaaagatacaaaagaagctatatcatctgaagtggacactcaaagtacagaagattcagaattagaaactatctcagtcactgcagaaaaagtaagagatcgtaaagataatgaagtaactggacttggcaaaattatcaaaactagtgaaagtatcagccgagaacaagtattaaatattcgtgatctaacacgctatgatccagggatttcagttgtagaacaaggtcgcggtgcaagttctggatattctattcgtggtatggacagaaatagagttgctttattagtagatggtttacctcaaacgcaatcttatgtagtgcaaagccctttagttgctcgttcaggatattctggcactggtgcaattaatgaaattgaatatgaaaatgtaaaggccgtcgaaataagcaagggggggagttcttctgagtatggtaatggagcactagctggttctgtaacatttcaaagcaaatccgcagccgatatcttagaaggagacaaatcatggggaattcaaactaaaaatgcttattcaagcaaaaataaaggctttacccattctttagctgtagcaggaaaacaaggtggatttgaaggacttgctatttacactcaacgaaattcaattgaaacccaagtccataaagatgcattaaaaggcgtgcaaagttataatcgattaatcgccaaagaagatggatctaatgcatactttgtgatggaagatgagtgtccaaaggattataacagttgtataccttcagccaaaccacctgcgaagttatcctcccaaagagaaaccgtaagcgtttcagattatacgggggctaaccgtatcaaacctaatccaatgaaatatgaaagccagtcttggtttttaagaggaggctatcatttttctgaacaacattatattggtggtatttttgaattcacacaacaaaaatttgatatccgtgatatgacatttcccgcttatttaagatcaacagaaaaaccggatttagaaaatagttctttttatccaaagcaagattatggtgcatatcaacgtattgaggatggccgaggcgttaaatatgcaagtgggctttatttcgatgaacaccatagaaaacagcgtgtaggtattgaatatatttacgaaaataagaacaaagcgggaatcattgacaaagcagtgttaagtgctaatcaacaaaacattatacttgacagttatatgcaacatacacattgcagtctttatcctaatccaagtaagaattgccgcccaacacttgataaaccttattcatactatcattctgatagaaatgtttataaagaaaaacataatatgttgcaattgaatttagagaaaaaaattcaacaaaattggcttactcatcaaattgtcttcaatcttggttttgatgactttacttcagcgcttcagcataaagattatttaactcgacgtgttaccgctacggcaaagagtatttcagagaaacctggtgaaacaccaagaagaaatggtttcaaattacaaccttacttatacccaaaaccaaatgcatcttttgtaggacgagatcattgtaattatcaaggtagctcctctaattatagtgactgtaaagtgcggttaattaaagggaaaaattattatttcgcagcacgcaataatatggcattagggaaatacgttgatttaggtttaggtattcggtatgacgtatctcgtacaaaagctaatgaatcaactattagtgttggtaaatttaaaaatttctcttggaatactggtattgtcataaaaccaacggaatggcttgatctttcttatcgcctttctactggatttagaaatcctagttttgctgaaatgtatggatggcggtatggtggcaagaatgacgaggtttatgtaggtaaatttaagcctgaaacatctcgtaaccaagagtttggtctcgctctaaaaggggattttggtaatattgagatcagtcattttagtaatgcttatcgaaatcttatcgcctttgctgaagaacttaaaaatggaaagggcaagggcaattatggatatcataatgcacaaaatgcaaaattagttggcgtaaatataactgcgcaattagattttaatggtttatggaaacgtattccctacggttggtatgcaacatttgcttataaccgagtaaaagttaaagatcaaaaaatcaatgctggtttagcctccgtaagcagttatttatttgatgccattcagcccagccgttatatcattggtttaggctatgatcatccaagtaatacttggggaattaatacaatgtttactcaatcaaaagcaaaatctcaaaatgaattgctaggacaacgttcattaggtaacacttcaaggggtgtaaaatcaacaagaaaacttactcgggcatggcatatcttagatgtatcgggttattacatggtgaatagaagtattttgttccgattaggagtatataatttattaaactatcgctatgtcacttgggaagcggtgcgtcaaacagcacaaggagcggtcaatcaacatcaaaatgttggtaattatactcgctacgcagcatcaggacgaaactataccttaacattagaaatgaaattctaa

SEQ ID NO: 96 - DNA, 1893 bp, Haemophilus influenzae
atgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaagtag

SEQ ID NO: 97 - DNA, 1626 bp, Haemophilus influenzae
atggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtatctaactggggtttagcgattatctgtgtaacaattgtagtgaaagcaattttgtatcctcttacaaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggtttagagaaaaaagggttgcattctcgtaaaaaatag

SEQ ID NO: 98 - DNA, 1002 bp, Haemophilus influenzae
atgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcgggacgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaacattatgcagaagtgattggtactcgccgttttgatgatcgtcttagtaccttaggaaaagtgcgcaaagctggattaaaagtgtgttgtggtggcattgtggggatgaatgaaacccgtaaagaacgggctggattaatcgcgagccttgcaaatcttgatccgcaacctgagtcagtgccgattaatcaactcgttaaggttgaaggtacaccgttagccgatgcggaagaattagattggacggagtttgtgcgaacgattgctgttgcacgtattactatgccaaaaagttatgttcgcctttctgcaggtcgtagtggtatgactgaagaaatgcaagcgatgtgttttatggcgggggcaaattcgattttctatggcgataaattacttgttacagataatccagaagaagatggcgatcagttattgatggcaaaattagatttagagccagaaactgcagaaaataaaaagttgtag

SEQ ID NO: 99 - DNA, 1203 bp, Haemophilus influenzae
atgagtaaaactatgatctctcgtgaaaattatttacagcaactgattcaatttaaagatactgattttatcaaagtcatctcgggtgttcgtcgttccggtaaatcggtgctactcatgcaataccgtgattaccttcaacaacaaggcattgcttccgaaaatattctttatctcaattttgaatcttttgaatatcaatgggtgaaagacgctcaagattttcaacagctgattcaagaaaaaatgccgtcttctcaaaagaaaatctactttctgattgatgaaattcagtttgtggaaggttggcaaaaaatcgtcaatgggcttcgcgtgagttttaacgctgacattgtgattacaggttccaatgctaacttgctttccggcgagcttgcgacgttgttaagcggtcggtatgtagaaatcaaaatttatccgctttctttcaaagaatttttgcacgccaaaaatgtggatagccaatcaagattggtcgataaactctattcggaatatgaaaaatatggcggtttccccagcgttgtgatggctgatgagcctttaaaagaaacgattttatcgggtatttttgattccatcgtgctaaatgatattgcccaccgagctggagtgaaagacacgcatattcttaaaagtgtaattctctttttagcggataacgtagggcagttggtgaatccaagcaaaattagcaacacgctcacgtccgaacgtgttcccacttcaaatcacaccataagcaaatatcttgatttgttagaaaatgcctttcttttttataaagcaaaacaatacgatattcgcggaaaaggctatttaaaaaccaatgccaaatattttattgtggataacggtttaagacgacacgctatcggcaaaaaaggtgcgaattatgccaatcgcctagaaaatattgtctttattgaattgcttagacgaggttataccgttgatgtgggtaaactcgacagcaaagaaattgattttatcgcccgaaaagctgatgaaattttatatgtacaagtcgcttttgaaatccctgaaaatacccacgaaacagataatcttttgcatattaaagataactataaaaagattttaattacggggaaatattacgaacaaacagagattgatgggattgaagtgatttatgtggtggattggttgttgcaataa

SEQ ID NO: 100 - DNA, 2421 bp, Haemophilus influenzae
atgagtaactttaatcaaataagtcgccgagattttgtcaaggcgtcatctgcgggagctgcactggcagtttcaaatcttactttacctttcaatgtaatggctaaagagacacaacacctcaatgaaaatagtcaggaacgtattgtttggagtgcttgtacagtaaactgtggtagccgttgtccattacgaatgcacgtaaaagataaccgaatcacttatgtggaaaccgataatacggggacagaaacatataatcttgatcatcaggttcgtgcttgtctacgtggacgttctatgcgtcgtcgagtgtataacccagaccgtttaaaatatccaatgaaacgtataggtaaacgcggagaaggtaaattcaaacgaatcagttgggatgaggctttaactgaaattgcagacgcattgaaacgcaatatcaaaaaatatggcaatgaatcaatttatttaaactatggtacgggaacactcggtggcacaatggctaaatcttggcctcctgcatccactatgatcgctcgttttatgaattgtattggtggatatttaaaccattatggtgattacagcaccgcacaaattgcagtcggtttagattatacctatggtggtggttgggcattgggaaatggaatggctgacattgaaaacaccaaattaatagtgttattcggtaataatcctgcagaaactcgtatgagtggaggtggtttaacttattgtattgaacaagccaaagctcgttccaatgccaaaatgattattatcgatcctcgttataatgatactggtgcagggcgtgaagatgagtggatcccaattcgtccaggcactgatgcagccctcgtttctgcccttgcttatgtaatgattcaagaaaatctcgtggatcaacctttcttagataaatattgtgttggttatgatgaaaaaacattacctgcggatgcccctaaaaatggtcattataaagcctatattttaggttatggtaatgatggtatcgctaaaaccccagaatgggcggctaaaatcacgggtattccggcggagagaattattaaactcgcacgtgaaattggcagcacaaaacctgcctttatttcccaaggttgggggcctcaacgtcgtagtaatggagaattaatctctcgtgccattgcgatgttgccaatcttaacaggtaatgttggaattcacggcggtaacactggtgcacgtgaaagtgcgtatagcattccatttgtgcggatgccaacgctaaaaaatcctgtgaaagcaagcattccaatgtttttatggacagatgcaattattcgtggcacagaaatgaccgcacttacagatggtattcgtggtgttgataaattatcgtccccaattaaagtaatttggaattacgcaagtaactgtttgattaatcaacacgcacaaatcaatcgtactcacgatattttacaagatgatacccaatgtgaaatgatcattactattgataatcatatgacatctactgccaaatacagtgatattttattaccagattgtacaacttcagaacaaatggatttcgctttagatgcctttgtatccaatatggcctatgtcatttttgcagatcaagtgatcaaaccatcttttgaatgtagacctatttacgatatgttgagtgatttagctgagaaaatgggcgtaaaagaaaaatttactgaaggaagaacacaagaggaatggttacgccatatttatgagcaatctcgagaaaaattacctgaattacctacttttgaagaatttagacaacaaggtatttttaaaaaggttgatcctaatggctttaaagttgcatacaaagatttccgtgataatccagaagcccatccacttaaaacgccatctggcaaaattgaaatttattcttctcgtctagctgaaatagcaaacacttggaaattagcagaagatgaaataattcatcctttaccaattcacgcccaaagttttgagcattacggcgatccattaatggaaaaatatccgctacaactaagtggttttcactacaaagcaagaacccattcaacttatggcaatgtggatgtattaaaagcagctaatccacaagaagtttggatgaatcctattgatgcagaacctcgtaatattaaaaatggcgatatgattcgtatctttaatgatcgaggcgaagtacgtattaatgtaaaaattaccccccgtattattccaggggttgtggcattaagcgagggggcttggtatgcaccagataaagatcgtatcgatcattcaggttgcattaatgtacttacgacacaacgcccatcaccgcttgcgaaaggtaatccgcaacattctaatttagttcaagtggaacgtttgtag

SEQ ID NO: 101 - DNA, 3837 bp, Haemophilus influenzae
atgcgggtggatcaacgtcgcttatccgcccgcattcatggtattggaaaaattaaaagccaagaggctcaacaagccgttgccgctgaaatccaacagcaaattgaacaagctagattacgtgtagaacaacggaaaagtgcggtacaaaatccgattatttttccagagagtttgcccgttagccaacgcaaagtcgaaattcaaaaactgctttctgaacatcaggtcatcgtggtggcaggggaaactggttcaggtaaaaccacccaattgccgaaaatgtgtttggaattaggtttcggcaatttaggcatgattggtcatactcaaccacgccgtattgctgctcgttcggtggcggcacgtattgcggaagaactggaaacagaacttggcgatttagtggggtataaagtccgttttaacgatcaaatcagcgataacacccaaatcaaattgatgactgacgggattctgctagcagaaattcaaaacgatcgttttctcaatcaatattcttgtttgattatcgatgaagcccacgaacgtagcctaaataacgattttattctcggttatctgaaacagttgttgccacgtcgtcgtgatttaaaacttattatcacttctgcaaccattgatgtggaacgcttttccaaacactttaataatgcaccgatcattgaagtctcaggcagaacctatcctgttgaagtgcgttatcgtcccgtagtggaggacgatcaagatcagctacaaggcattctcaatgcggtggatgaattgcaagcagaaggtcgaggcgatatcttgatctttatgaatggagagcgtgaaattcgtgataccgccgaagctttacaaaaacaaaatctaaaatacacggaaattctaccgctctttgcacgcttgtctgcgcaagaacaaaataaaattttccatccaagcggtttaaatcgcattgtattggcgaccaacgtcgcagaaacctcattgaccgtacctggcattaaatatgtgattgacccaggtacagcgcgcatttcccgttatagctatcgcaccaaagtacaacgtttaccgattgaacctatttcacaggcatctgctaatcagcgtaaaggtcgatgtggtcgtgtaagtgaagggatttgtattcgtttatattcggaagaggattttaattctcgtccagagtttaccgatcctgaaattctacgcaccaatttagcctccgttattttgcaaatgacggcattgggtttggatgatattgaagcgttcccatttgttgatgcgccagataaacgccatattcaagatgggataaaactgttggaagaattgggcgcgtttgaaactgttcaaactaaatcgggtgaaaaacgcctattaactagagttggtcgccaactcgctcaacttccagtcgatccgcgccttgccaaaatgatcctaagtgcggtcaattttggctgcgtttatgaaatgatgatcatcgtctctgcgttatccattcaagatccgcgcgagcgtccacaagaaaaacagcaagcttctgatgaaaaacatcgtcgttttgccgataaaaaatcagatttcttggctttcctcaatctttggtattatctacaagaacaacaaaaagaattgagtaaaaaccaattccgtcgtcagtgccaaaaggatttcttaaattatttacgcattcgtgaatggcaggatatttatcatcaaattcgtttaaccgtgcgtgaaatgggcttaccgattaattctgaaaaagcagaatatcagcaaattcataccgcacttttaagcggtttgctttctcatatcggtttaaaagaagcggagaaacaacaatatcttggcgcacgtaatgcccattttgcgattttccccaattctgtgcttttcaaaaaacaaccgaaatgggtgatggcggcagagttagtggaaacctccaaactttgggggcgtatggtggcagaaatcgagccagaatggattgagccacttgccgagcatctcattaaaaaatcctattcagaaccgcgttggtcgaaatcccgtggcgccgtgattgcagatgaaaaagtcacactttacggtgtgccgattgtggctgcgagaccagtgaattacggtgctattgatccaacggtaagccgtgagatttttattcaatctgccttggtggaagggggttggaataccaagcataaattcttcaaagaaaatcaaaggctcgttcaagaagtagaagaattggaacacaaaagccgccgccgcgatattttggtggatgatcgcacattgtttgaattttacgatcagcgtattggcacggaagtggtttcccagaagcattttgatacgtggtggaaaaaggtgcagcaaaaagatcctgaattgcttaattttgaacgttcatttttgatcaatgatgatgcggaacaagtgagcaaactggatttcccgaatttctggtatcaaggtaatttaaaactcaaattgacttatcaatttgaaccaggtaccgatgcggacggcgtgacagtacatattccattgccattgctcaaccaagtggaaatgacaggctttgactggcaaattccaggcttgcgtgaagagttggtgattgcgctgattaaatcgctgccgaaatcttatcgccgtaacttcgtgcctgcacctaattatactcaagcttttttaagtcgtgcggtgccgttggaaaagccattattagatacgctgatttatgaattgcgtcgtatgactggcgtcaccgtagaagcggaacattggaattgggaacaaattccaagccatctgaaaatgacgttccgtgtggtggatgaaaacggtaagaaaatcgcagaatccatgaatttggatgagctgaaattcaacttaaaagatcgtgtgcaggaaagtatttctgctgtggcagatgatggcattgagcaaagcaggctgcatatttggagctttgcagatttaccacaatgttatgaacaaaaacaacgtggtttcagcgtcaaagcgttcccagctattgtagatgaaaaagatgcggtgggtatcaaactgtttgaaacagagtttgagcaatcggtggcgatgcaacaaggtttacgtcgtttgttattgctcaatgtgccatcaccaattaaatatcttcatgaaaaattgccgaataaggctaaattgggtctgtattttactccgttcggtcgcgtattggatttgatcgatgactgtattgcttgtgccgtagataagctaattgccaattttggcggttttgtgtgggatgaagcaggatttgaaaaattgcgtgatttcgttcgagaaaaccttaacgaagtgaccgtggatattgcgcagaaagtggagcagattcttactctcacttaccaacttaaccaacgccttaaaggcaaaatggatttcacgatggcatttgcattatccgacatcaaatcgcaacttgcaggtttggtgtatcaaggttttgtgcaaaagagcggttatgatcgcctaccagatttacaacgttatctgcaagccattgataaacgtattgataagttggctcaagatgtaaaccgtgatcgtgctgcgatgctacgcgtggaacaagtgcaacaggcttaccaacaattactggctaaactgccaaaatctaaaccgatttctgatgaaattgcggaaattcgctatatgatcgaggaattgcgtgtgagtttatttgcccagcagttggggacaaaatatcaaatatcagataaaagaatagcaaatattattagtcaatactaa

SEQ ID NO: 102 - DNA, 1638 bp, Haemophilus influenzae
atggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggggaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaagcattaaatatattgattcccaagatgttgaaaccaaaggtgttgaagtattaaaaggcgttgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccacgctcgtgagctttatggcaaagaaaccattgaagaacgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaa

SEQ ID NO: 103 - DNA, 1275 bp, Haemophilus influenzae
atggataaatttcgtgtttatgggcaatctcgtttaagtggaagtgtgaatatttcaggcgcaaaaaacgccgcacttccaattctttttgcggctattttagctacagaacctgttaaattgacaaatgttcccgaacttaaagatattgaaacaactttaaatattttgcgtcaattaggcgtaattgcaaatcgtgatgaaactggtgcagttttattagatgcctctaatatcaatcatttcactgcaccttatgaattggttaaaactatgcgtgcttcaatttgggcattggcacctttagtcgctcgtttccatcaagctcaagtctcattacctggaggttgttctatcggagctagacctgttgatctccacattagcggtttagaaaaattaggtgcggacatcgttcttgaagaaggatatgtaaaagcacaagtatcagatcgtcttgttggaactcgaattgtaatagaaaaagtaagtgtaggcgcaactttatctattatgatggcagcaacccttgcgaaaggtacgactgttattgaaaacgccgctcgtgaacctgaaattgtagatactgcagatttccttaataaaatgggtgcgaaaataacaggtgcaggttctgatcacattacgactgaaggtgttgaacgtttaactggttgtgagcacagtattgtgccagatcgcattgaaacgggtacattcttaattgctgcagcaatttcgggcggtcgtgttgtttgtcaaaatactaaagcggatactttagatgccgtaattgataaactccgtgaagctggtgcgcaagttgatgtaactgaaaatagcattactttagatatgcttggtaatcgccctaaagcagtgaatattcgtactgcaccacatccagggttcccaactgatatgcaggctcaatttactttattaaatatggtggcagaaggtacaagcattatcactgaaacgatttttgaaaatcgttttatgcatattcctgaattaattcgtatgggtggtaaagctgaaattgaagggaatacagcggtatgtcacggggttgaacaattgtctggcacagaggtaatagcgacagatttacgcgcttcaatcagtttagtgcttgcaggttgtatcgcaacgggtgaaaccattgtagatcgtatttatcatatcgatcgtggttatgaacatatcgaagataaattacgtgctctaggtgcgaaaattgaacgtttttctagaagtgatgaagcgtaa

SEQ ID NO: 104 - DNA, 639 bp, Haemophilus influenzae
atgtttgagcaacacaagttatctctgcaaaatttatcctgccaacgtggtgagcgcgtactttttcgtgctttgacttgcgattttaatagcggtgattttgtacaaattgaagggcataacggcataggtaaaacgagcttgttacgtattcttgctggtttagcccaacctttagaaggcgaagtgcggtgggatgctgaagcaatttctaaacaacgtgaacagtatcatcagaatttgctttatttaggacatcttttaggcgttaaaccagagctaacggcgtgggaaaatttgcagttttatcaacgaattagtcaagctgaacaaaacaccgatatgttgtgggatttgcttgagaaagtgggattattagggcgtgaagatttgcctgccgcacaactttctgcaggacaacaaaaacgtatcgcgttaggtcgcttatggctgtctcaagcgcccttatggattttagatgagccctttactgcgattgataaaaaaggcgtggaaattctaaccgcactttttgatgagcatgctcaacgtggaggtattgtgttattgaccagccaccaagaagtgccaagttctcatctgcaaaaattgaatttagcggcttataaagcggaataa

SEQ ID NO: 105 - DNA, 2013 bp, Haemophilus influenzae
atgacaaatattcaaactcaactagacaatctacgcaaaaccttgcgccaatatgaatacgaataccacgttttagataatccgagcgtgcctgatagcgaatacgatcgtttatttcatcagctcaaagccctagaattagagcatcctgaatttctgacgtcagattcgcccactcaacgtgttggtgcaaaaccactttctgggtttagccaaattcgtcacgaaattcctatgctctctttggataatgctttttccgatgcagaatttaatgcttttgtaaaacgcattgaagatcgtttaatcctattaccgaaaccacttactttctgttgcgaacctaaacttgatggcttggctgtgagtattttgtatgttaatggtgaacttacacaagccgccactcgtggtgatggcaccacaggcgaagatattacagccaatatccgcacgattcgtaatgttccattacaacttttaacagataatcctccagcacgtttagaagtgcggggcgaagtttttatgccgcacgcaggctttgagcgtttaaataaatatgcgttagaacataatgaaaaaacctttgctaatcctcgcaatgcagcggcaggctctttacgccagcttgatcctaatattaccagcaaacgtccgctggtattaaatgcttatggtattggaattgctgaggggattgatctgccgactacgcattatgatcgtttgcaatggctaaaatctatcgggattccagtaaatcctgaaattcgtttatgcaatggtgcagatgaagttttaggtttttatcgagatattcaaaacaaacgtagctcgttaggttatgatattgacggaacggtattaaaaatcaatgatatagccttacaaaatgaactaggatttatttctaaagcacctcgctgggcgattgcttataaattccccgcccaagaagaattaaccctgttgaatgatgttgaattccaagtgggtcgaactggcgcaatcacaccagttgccaaattagagccagtgtttgttgcaggcgttacagtaagtaatgccaccttacataatggcgatgaaattgaacgtttaaatatcgctattggcgatactgttgttattcgtcgagcaggcgatgtaattccacaaattattggcgtattacacgaacgtcgccctgataatgctaaaccaatcattttcccaacaaattgccctgtgtgcgattctcaaattattcgtattgaaggcgaagcagtagcacgttgcacgggaggattattctgtgcggcacagcgtaaagaggcgttaaaacatttcgtctctcgtaaagcaatggatattgatggtgtaggcggaaaattaatagagcaattagtcgatcgagagctaattcatacacctgcggacttatttaaacttgatttaaccacgctcacacgcttagaaagaatgggtgcaaaatctgcagaaaacgcactcaatagtcttgaaaatgcaaaaagcacgacgcttgatcgctttatttttgctttaggcattcgtgaagtgggcgaagccactgcattaaatcttgctaatcatttcaaaactttagatgcgcttaaagacgcaaatcttgaagaacttcaacaagtgcctgatgtaggggaagttgtagcgaaccgaatttttatattttggcgtgaagcgcataatgttgcagtcgtggaggatttaatcgcacaaggtgtgcattgggaaactgtagaagtgaaagaagcgagtgaaaacttgttcaaagataaaactgtagtactgacaggcactcttacacaaatggggcgtaatgaagcaaaagccttattacaacagcttggtgcaaaagtaagtggttcggtatccagtaaaacagatttcgttatcgcaggtgatggggcaggctctaaacttgcaaaagctcaagaactaaatattacagtattaacagaagaagaatttttagcacagataacaagataa

SEQ ID NO: 106 - DNA, 987 bp, Haemophilus influenzae
atggatttaaatacaattttgattattgtgggtatcgtagcacttgtcgccttaatcgtacacggattatggtcaaatcgtcgtgagaaatcaaaatattttgataaagccaataaatttgaccgcacttctccaacatctagatcccatacgcaagaagaaatggtacagccaaacaatatttcgccgaatacctatgtggaaaatgggcatacaccaatttctcaaccgaccacagaaaaattaccatcagaagctgaattgatcgattatcgccaaagcgataaaagtgtggatgacatcaaaatttctattcctaacacgcaacctatttatgatatggggaatcatcgttccgagccaatacaaccaacgcaacctcaatacgatatgccaaccgcaaataatgtcgcaagtatgaccttagaacaacttgaagcacaaagtcaaaatgttggttttaatggcattaattcatcatcgccagaattaagagtgcagcttgcagaattatctcacgaagaacatcaagtagactacaacctctcgttcaatgaaccaaaagcagaaacgacagctcagccaaaacaaacaactggctatattcaactttatcttattccaaaatctagcgaagaatttaatggtgctaaattggtgcaggctcttgaaaacttgggttttatcttgggtaaagatgaaatgtatcatcgtcacttagatttaagtgtggcaagtcccgtgctttttagtgtggcaaatttagaacaacccggcacattcaatgcttataacttagcggaatttaacaccataggaattgtattatttatgcaattgccctctccaggtaataatcttgctaatttacgtatgatgatgcgtgctgcccatacattagccgaagatttacaaggtgttatactgactgaagaacaagaaatttttgatgcaaatgcagagcaagcctatcttgctcgagtgtaa

SEQ ID NO: 107 - DNA, 999 bp, Haemophilus influenzae
atgacagtctcaaacaacaaagaattactccttgaagtcaatcacttaggcgtcagttttaaaattaaaaatgataaatcccttttcttcgccaaaccgcaaaccttaaaagcggtgaaggatgtgtcttttaaactttacgcaggtgaaactctcggcgtagtaggtgaatctggttgtggtaaatccacacttgcacgcgctattatcggtttagtcgaagcgagtgaaggggaaatcttgtggcttggtaaacatttacgaaaacaatcagcgaaacaatggaaagaaacgcgtaaagatattcaaatgattttccaagatccgctcgcctctctcaatccgcgaatgaatattggcgaaatcattgctgagccattaaagatctaccaaccgcacttaagtgccgccgaagtgaaagaaaaagtgcaagctatgatgttgaaagttgggcttttaccgaacttgattaaccgctacccacatgaattttctggtggtcaatgtcagcgtatcggtattgctcgtgcgttaatcattgagcccaaaatgatcatttgtgatgagcccgtttcagcgttagatgtgtcgattcaggctcaagtggtgaatttattgaaatccctgcaaaaagaaatggggctttccttaatttttatcgcccatgatttagcggtggtaaaacatatttctgaccgcgtattagtgatgtatttaggcaatgcaatggaattaggcagcgatgtggaagtatataacgataccaaacatccttataccaaagccttaatgtctgctgttccgatccccgatccaaaattggaacgcaataaatccatcgaattacttgaaggtgatttgccttcgccaattaatccaccgtctggttgcgtatttcgtactcgctgtctaaaggctgatgagaattgtgcgaaacaaaaaccacctttcaccagccaaaacaacagccattttgtggcttgcttgaaagtcttataa

SEQ ID NO: 108 - DNA, 1626 bp, Haemophilus influenzae
atgcaacacaaactactcttctctgcaatcgctcttgctctttcctattctgtgcaagcagttatagtgcctgaaggaacacaattagatgaaaaacaacatatcgtcatcaataacggggctgaaccgcaaagttttgacccacacaaaaccgaaggtgtgccagaatctaacgttgcttatcaattacttgaaggcttagtcacctcagactctgaaggtaaacttcaaccgggtgcggctgaaagctgggaaaatacacctgacttcaaaacctggacattccatttacgtaaagatgctaaatggtcaaacggagatcctgttactgcacacgatttcgtgtttgcgtggcgtcgtttagtggatcctgcaactgctgcaccttatgcgagttacttaagttatttacaagttgaaaatgcgcaagacattattgacggtaagaaaaaaccggctgaattaggcgtggaagcaaaagatgattacacctttgtggttcatgcaaccaatcctgtgccttatgcagtcagtttaacgactcaccaatccttattgccattaccacaaaaagtagtcgaaaaattgggtgatgcatgggtgaaaaaagaaaactacgtgggtaacggtgcgtataagctggctaaccacatcattaacgaaaaaatcgaatttgaacgtaacccactttattggaacgataaagaaaccgtaatcaatagtgcgacattcctcgccattgaaaacccaagtaccgatgtagcacgttatcgtgcgggcgatttagacatgaccagttatggtttaccgccagaacaattcgctaaattaaaaaaagaattgctaggcgaagtatacgttactcgtaccctaggaacttattcttatgaattaaacaataagaaagcaccttttgataacgtgaatattcgtaaagccttgaacttatcccttgatcgtaatgtgatcaccgataaagtattgggccaaggtcaaacaccaacctatgtgtttaccccaacttacatcgaagaaggtcatctcattcaacaacctgcttattcaaaagaaccgatggcacaacgtaatgaagaagccattaaactcttagaagaagctggttacagtaaagcgaatccgttgaaattcagcattctttataataccaatgaaaaccacaaaaaagtggctattgctgcagcttctatgtggaaagctaacaccaaaggtttgattgatgtgaaattagaaaaccaagagtggaaaacttacattgatagccgtcgtgcaggtcgttacgatgtggcgcgtgctggatggcatgcggattacaaccaagcaacaacattcggcaactatttcttatctaattctagtaacaataccgcgaaatatgcgaatccagaatatgataaagcgatggcagaatcttacgcagcaactgatgcagaaggtcgtgcaaaagcttatgcgaaagccgaagaaattcttggaaaagattacggtatcgtaccaatctttaactatgtgaatccacgcttagtgaaaccttacgtaaaaggttattcaggcaaagatccacaagatcatatttacttacgcaatctttatattattaaacattaa

SEQ ID NO: 109 - DNA, 1833 bp, Haemophilus influenzae
atggtgaaatttaattcctcgcgtaaatcaggtaagtcaaaaaaaacaattagaaaattgaccgcacctgaaactgtaaagcaaaacaagtctcaaaaggtgtttgaaaaatgctttatgcgtggacgttatatgctttctacggttcttattttacttggtctgtgtgctttagtcgcacgagcagcttatgttcaatctattaatgccgatacgttatcaaatgaagcggataagcgttctttgcgtaaagatgaagtattatcggtgcgtggttctattttagatcgtaatggtcagcttttatctgtaagcgtaccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtattgatgaaaaattgcaatctatggtgtatcgtgagattaaaaaggcggtgtctgagaataatgcggagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtcgttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagcgcattaatggaaacttatcaaaatgcaggtttaagtaaaccgacagatttaggcttgatcggagaacaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgcccgctttctatcactaaagttgatccgccagttattgggaaacgggttttctctgaaaaaataactaaagatattgtgggaattttagagaaagtagcaattaaaaataaacgcacaatggtggaaggctaccgtgtcggcgtaaaaacaggtacggcacgtaagattgaaaatggacattatgtaaataaatatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgaattgtttatattggcgaacacaagaatcaaaaagtgaattaa

SEQ ID NO: 110 - DNA, 1467 bp, Haemophilus influenzae
atgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatctagcgagcatttaactgtggcgtttatcaggaatgtgccggtagttaaatattatcaacttgcacgtcatctttcgtccttagctgatgttttttatgattcgccctctaaaaatttaacccttgttggcgttacaggaacaaatggcaaaaccactatttctcaattattagcgcaatgggcggaattattggggcatcgtgcggctgtgatgggaaccattggtaatggacttttggggcaaattgtagaagctaaaaatacgacaggttcagcagtagaaattcagtcatctctttcaactttcaaacacgcaggtgcagattttacctctattgaagtttcatcacacggtttggcgcagcatcgtgtagaagccttgcattttaaagcggcaattttcacgaatttaacccgtgatcatctagattatcatcaatctatggaaaattatgctgcggcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaatcgttattgtagattatgcgcatacaccagatgcgttggaaaaagcgttgattgctgcgcgtgaacattgccaaggcgaattatggtgcatctttggttgtggcggagaccgtgatagaggcaaacgtccgttaatggcacaggttgcagagcagtttgctgaaaagattattgtgacaaaagataatccacgaacagaaccacaaagccaaattgaagcagatattgtcgctggctttaaaaatatggaaaaagtggggattattcctgatcgcgcacaggcgatccagtttgcgattgaaagtgcggtagaaaatgacgtgattttaattgctggaaagggtcacgagcattatcaaattattggttcggaagttgtgcatttttccgaccaagaaattgcacttgatttcttaaaataa

SEQ ID NO: 111 - DNA, 921 bp, Haemophilus influenzae
atgaacttaaaacaagaaaaaatcgcggtgttattaggcggcacatctgctgaacgtgaagtttctttcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacggggtgtggcgtgatggcttctgcattaacgatggacaaaatgcgtacaaaaatgttgtggaaagcttttggtttacctgttgcagatatgaaagtggttacccgagaaactttttctgaattagatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagagttagcaatattagtaaaacgtgcttatgatgcactgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagttgagcctgtaa

SEQ ID NO: 112 - DNA, 1323 bp, Haemophilus influenzae
atgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgcaaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaa

SEQ ID NO: 113 - DNA, 1761 bp, Haemophilus influenzae
atgaataaacttcgccaaaaatatttacaaaaatggcttcgcgcacaacaagaacctatcaaaaaattaatgcgtgcaaacattgtcttagctacgctttcttcattcattttagtcgcacaaacttattttcttgcgacgttgctcgataaactgattatgcaaaatgtgcctcgtgatgaacttattccttattttctcgggctaattatcggcttcgggatgcgtgctattattttatgggcacgcgaaaaaataggtttccaaagcggacaattattacgcaaccatattcgtcaaaaaattctggataaaattcatcttgtcggccctgcgacaatcaatcaaaaaccagctggaagttgggcaagcattatgttggaacaagttgaaaacttacataatttctatgcccgttttctgcctcaacaaagtctttcagccattgttccagtggttattttcattgctgtatttcccttgaactgggctgcaggcttaatcttaatgattaccgcaccgcttgttcctctgtttatgatcattgtcggtattgctgcggctgacaacagccaaaaaaatatggataccctttctcgcctcagtgcccaatttttagatcgcttacgcggtttggaaaccttgcgtctttttaaccgcacttctgaacaaactgagcatattgaaaatgccactgaagatttccgtgaaaccacaatggatgtgctaaaactcgcttttctctcttctgcagtattggaattttttacctctatttccattgcactgatggcggtctattttggttttagctacttaggtcaaattgaatttggtacctataatgcaccgcttacacttttcacaggtttcttttgtttaattcttgcacctgaattttatcaacccttacgcgatctaggcacctattaccacgaccgtgcagcaggtattggtgcagcggatgccattgttgattttttagaatctgattatttaactgtacatcaaaatgaaaaaacaatttctttagaaagtgcggttgaaatttctgccgaaaatttagtggtgctttcgacacagggttcagcattaaccaagccgttaaacttccaaattccagcaaatcataatgttgcgcttgtaggacaaagtggcgcgggaaaaacttcattaataaatgcgattctgggctttttaccttatgagggctcgctcaaaattaatgggcaagaacttcgcgaaagtaatctagctgactggcgcaaacatattgcgtgggtaggacaaaatccattgttattacaaggcacaattaaagaaaacttactacttggcaatattcaagccaacgatgaagaaattaatcaagctttaatgcgttctcaagcgaaagaatttaccgataaacttggacttcatcacgaaataaaagatggtggattaggcatttctgtgggacaagcgcaacgccttgccattgctcgggcattgttacgcaaaggcgatttacttctgctcgatgagccaaccgcaagcctagatgcgcaatcagaaaatcttgttttacaagcattgaatgaagcaagtcagcatcaaactacactgatgattacacaccgaattgaagatttgaaacaatgtgatcaaatttttgtgatgcaacgaggagaaatagtacagcaaggtaaatttaccgaattacaacatcaaggtttctttgctgaactactcgctcaacgacaacaggatatccaataa

SEQ ID NO: 114 - DNA, 1080 bp, Haemophilus influenzae
atgaaaaaaactgcaatcgcattagtagttgctggcttagcagcagcttcagtagctcaagcagctccacaagaaaatactttctacgcaggcgttaaagctggtcaaggatctttccatgatggtattaacaataatggcgcaattaaacagaatttatcatctgctaattatggttacagacgcaatactttcacttatggtgtatttggtggttaccaaattttaaatcaagataattttggtttagctgctgaattaggttacgacaattttggccgtgtaaaacttcgtgaagcaggaaaacctaaagctaaacatactaaccacggtgcgcacttaagcttaaaaggcagctatgaagtgttagacggtttagatgtttatggcaaagcaggtgttgctttagtacgttctgattataaattttatgaagttgcaaacggtactcgtgaccacaagaaaggtcgtcacacagcacgtgcctctggtttatttgcagtaggtgcagaatacgcagtattaccagaattagcagttcgtttagaataccaatggctaactcgcgtaggtaaataccgccctcaagataaaccaaataccgcaattaactacaacccttggattggttctatcaatgcgggtatttcttaccgtttcggtcaaggcgaagcaccagttgttgcagcacctgaaatggtaagcaaaactttcagcttaaattctgatgtaactttcgcatttggtaaagcaaacttaaaacctcaagcacaagcaacattagacagcgtctatggcgaaatttcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaaaggtcgtaaagcgcttatcgcttgtcttgctccagaccgtcgtgtagaaatcgcggtaaacggtactaaataa

SEQ ID NO: 115 - DNA, 513 bp, Haemophilus influenzae
atgaaaaaatctttattagcagttattgttggtgcatttgcctttgcttctgttgcaaatgcgaatatttatgctgagggcgatatcggtttatctcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaa

SEQ ID NO: 116 - DNA, 2748 bp, Haemophilus influenzae
atgaagaaagctataaaattaaatttaattacacttggcctaattaatacaatcggtatgacgattacacaagctcaagccgaagaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtgtcgtttctgtaaatattcgtggcgaaaatggattaggtcgtgtcaatacgatggttgatggtgtaacccaaaccttctattctacagccttagactctggtcaatcaggcggaagttctcaatttggtgcggcaatcgatcctaattttattgcaggtgtagatgttaataaaagtaacttttcgggagcaagcggtataaatgcgttagcaggcagtgctaattttagaacattaggcgttaatgatgttattaccgatgacaaaccatttggcattattctgaaaggaatgacaggaagcaatgccactaaatccaattttatgacgatggctgctggcagaaaatggcttgataatggtggctatgtaggcgtggtgtatggttatagccaacgtgaagtttcacaagattaccgtattggaggcggagaacgattagcatcattagggcaagatattctcgcgaaagaaaaagaagcttattttcgtaatgcgggttatgttttaaatgatgctggacagtggactcctgatctaagtaagaacgcttggtcttgtaacgaagaccctcctcgtttagcagagaatatagagaatgttaaatgtacacattattcttttgatcctagaaaaaacgatagaaaagaaattctcaaaaaattaaaagctggaacaaaacctgagaatattgacgagctccaaaacggtaaggatggaattaaagaaactgacaaatcatttgaacgtaataaagatcaatatagtgttgcaccaattgagcctggtagtttgcaatcacgctcgcgtagccatttattaaaatttgaatatggcgatgatcaccaaaatttaggagcacaaatacgtacattggataataaaattggttctcgcaaaattgaaaaccgtaattaccaagtcaattataacttcaataataacaactatctcgatcttaatttaatggctgcacataacattggtaaaaccatttatcctaagggtggtttttttgctggctggcgagtggcagacaaacttattaccaaaaatgtggcaaatattgttgatataaacaacagccatactttcttgttgccaaaagaaatcgatttaaaaaccacattaggttttaactattttaccaatgaatacagtaaaaaccgttttccagaagaattaagtttgttttataacgatgattcacatgatcaaggtaactatagtaatttaggacgatttagaggtaatcgtaatttactgccacaacgttcagtgattttacaaccttctggcaagcaaaaatttaaaacggtgtattttgataccgcactttctaaaggtatttaccatttaaattacagcgtgaattttacccattatgcgtttaatggtgagtatgttggatatgaaaatacagcgaatcaaattaatgaaccgattttgcataaatcagggcataaaaaggcattcaatcattccgctacattaagtgcagagctaagcgattattttatgccatttttcacttattcacgcacacacagaatgccgaatattcaagagatgtttttctctcaagtgtctaatgcaggggtaaacacggcattaaaacctgaacaatctgatacctatcaactaggctttaatacttataaaaaaggtctcttcactcaagacgatgtgctaggcatcaaattagtgggttatcgtagctttattaaaaactatatccataatgtttacggtgtttggtggcgagatggcgttgtacctacgtgggcagacagtactggttttcgctttactatcgcacatcaaaattatcaacctatcgtgaaaaaaagcggggcggagttagagcttaattatgatatgggacgtttttttgcgaatgtctcttacgcttatcaacgtactaatcagccaaccaattatgccgatgccagctcacgtccgaataatgcttcaaaagaagacattttgaaacaaggttatggcttatctcgtgtttcaatgctaccaaaagactacggcagattagagattggtacacgttggtttgatcaaaaattaaccttaggtatggcagctcgttattatggaaaaagtaaacgtgcgacaattgaagaagaatatatcaatggatctcactttgaattaaagacctcaggtaaaagaacttactacgttgtgaaaaaaacagaagagattaaaaaacaaccgattattttagatttacacgtcagctatgaaccaatcaaagatttgattattaaagcggaagtacaaaatctattagataaacgttatgttgatccgttagatgctggaaatgatgcggcttcgcaacgttattattcaagtttaaatgattcaatttgtagtaaaagtcaggattgtgaagatggaggaaaagataaaaccgtgctttataactttgcacgtggaagaacttatattctgagtttaaactataaattctaa

SEQ ID NO: 117 - DNA, 2640 bp, Haemophilus influenzae
atgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgctttcagtcaatttttaaacctcactaacatagcagaacaatatcaaaccatttcccgtgaacattctcttgcacaaagttcttctcaatccttaagcgaacttttcaaacgcttaaaagaacaaaatgcttcagtggaagaggtgcataaaaccgtcgaaaaattattaattgagcttgttctgaccgcacatccaacagaaacaacacgtcgttcattaattcataaacacattgaaatcaataaatgtttaagcaagctagaacatcatgatttaacggaaaaagaacgcaatattattgaacgtctattacttcgtttaatcgctgaagcatggcataccaacgaaattcgtactgttcgcccaacgccatttgatgaggctaaatggggctttgcgatgttagaaaacagtttgtggcaagctgtgccagaatttttacgccaactcaacgaaaccgcccgtgaatttttaggttacgatttgccggtaggattaaaacctgtgcgtatttcctcttggatgggcggcgaccgtgatggaaatccatttgttaccgcacaaattaccaaaaaagtactttattttgcccgctggaaagcggcggatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggagccgctttacgattgttatcaatctttaattcaatgtggtatgcgcattattgcaaatggttcattgttggatattttgcaccgtattagttgttttggtgtgacgctttctcaaatggatattcgccaagaaagcactcgtcacaccgatgccattgctgaaatcatgcgctatattggtttgggcgattactctcaatggatggaagacgataaacaggctttcttaattcgtgaattaagctctcgccgtccattgattccgcaaaactggacgccatcgcctgaaaccaaagaaattttagatacttgtaaagtcattgctcaacaaaaacaaggtgtcattgcgtgttatgttatttcgatggcgcgcagtgcatctgatgttttagccgttcatttactcttaaaagaagctggcgtgccatatcatattcctgttgtgccattattcgaaaccttagaggatttagatgcagccgaaaaagtgatgactcaacttttcaatgtgggttggtatcgtggcgtgatcaataatcgtcaaatggtaatgattggctattcagattcggcaaaagatgcgggaatgatggctgcttcttgggcgcaataccgtgcgcaagaagccttagtaaatttaacagaaaaacttggcattgaactcactttattccacggacgtggtggcacaattggtcgtggcggtgcgccagcacatgcggcattactttctcagccacctcgttcattaaaaaatggtttacgtgtaacagaacaaggcgaaatgattcgtttcaaactgggtttacccgcagtagcagtagaaacctttgatctctacgccagcgccattttagaagcaaatcttttaccaccaccagaaccgaaaccagaatggcgtactataatggacgagctttccacgatttcttgcgatatttatcgtggtgtggtgcgtggcgataaagattttgtgccttatttccgcagtgcgacgccagaacaggaactctccaaattgccgcttggctctcgccctgcaaaacgcaatccaaatggcggtgtggaaagtttacgtgcgatcccgtggatttttgcctggatgcaaaaccgtttaatgctgccagcttggttaggggctggtgcagctattcgtcaagttattgaacaaggcaaaggcgatattattcataaaatgtgcgaaaactggccgttcttttcaacgcgaatcggaatgttggaaatggtatttagtaaatcggatacttggctttcccaacaatatgatcaacgattagtgaaaaaagagctttggtatttaggtgaaaatttacgtaagcaacttgaagatgatattcaaactgtgctttcactttctcaccaaagtgaattgatgtctgatttaccttggattgcagattcaattgcattacgtaatatctacacggatccactcaatctactgcaagtggaattgcttcaccgtttccgtgaaaatccagagcaagtcaatcccgatgtggaacaagcattgatgattaccatcacaggtatcgcggctgggatgcgcaatacaggctag

SEQ ID NO: 118 - DNA, 1191 bp, Haemophilus influenzae
atgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaa

SEQ ID NO: 119 - DNA, 1953 bp, Haemophilus influenzae
atgacaaaagaaaatttgcaaaacgctccacaaaatacgaccgtttcacttgtggaatcaaacaacaaccaaacttccccgcaaatgcttcaacaatcacccaaacctagcctattgcgcttggaacaacatatcgaaaaaaaagattatgagtttgcttgtcgtgaattaatggtgattctggaaaaaatggatgctaattttggaggcgttcacgatattgaatttgacgcacccgctcagctggcatatctacccgaaaaactactaattcattttgccactcgtctcgctaatgcaattacaacactcttttccgaccccgaattggcaatttccgaagaaggggcattaaagatgattagtctgcaacgctggttgacgctgatttttgcttcctccccctacgttaacgcagaccacattctcaataaatataatatcaacccagattccgaaggtggctttcatttagcaacagacaactcttctattgctaaattctgtattttttacttgcccgaatccaatatcaatatgagtttagatgcgttatgggcagggaatcaacaactttgtgcttcattgtgttttgcgttgcaatcttcacgttttattggtaccgcatctgcgtttcataaaagagcggtggttttacagtggtttcctaaaaaactcgccgaaattgctgatttaaatgaattgcctgcaaacatccttcatgatgtatatatgcactgcagttatgatttagcaaaaaacaagcacgatgttaagcgtccattaaacgaacttgtccgtaaacatatcctcacgcaaggatggcaagaccgctacctttataccttaggtaaaaaggacggcaaacctgtaatgatggtactgcttgaacattttaattcggggcattcgatttatcgcacacactcaacttcaatgattgcggctcgagaaaaattctatttagttggcttaggctctgagagtgtcgatgaaataggtcgagaagtgtttgacgagttttttgaaatcagtagcaataatataatggagagactgttttttatccgtaaacagtgcgaaactttccagcccgcagttttctatatgccaagcattggcatggatattaccacgatttttgtgagcaacactcggcttgcccctattcaagctgtagccttgggtcatcctgccactacgcactctgaatttattgattatgtcatcgtagaagatgattatgtgggcagtgaagattgtttcagcgaaacccttttacgcttacccaaagatgccctaccttatgtaccatctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatacattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgccttgaactccgtcgttacatcatagaaaacaacggcttacaaaagctttttacaggcgaccctcgtccattgggtaaaatactgcttaagaaaacaaatgaatggaaacgaaagcacttgagtaaaaaataa

SEQ ID NO: 120 - DNA, 1638 bp, Haemophilus influenzae
atgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtctactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaa

SEQ ID NO: 121 - DNA, 4629 bp, Haemophilus influenzae
atgaacaagatatatcgtctcaaattcagcaaacgcctgaatgctttggttgctgtgtctgaattgacacggggttgtgaccattccacagaaaaaggcagtgaaaaacctgttcgtacaaaagtacgccacttagcgttaaagccactttccgctatattgctatctttgggcatggcatccattccgcaatctgttttagcgagcggtttacagggaatgagcgtcgtacacggtacagcaaccatgcaagtagacggcaataaaaccaccatccgcaatagtgtcaatgctatcattaattggaaacaatttaacattgaccaaaatgaaatggtgcagtttttacaagaaaacaacaactccgccgtattcaaccgtgttacatctgaccagatttcccaattaaaagggattttagattctaacggacaggtctttttaatcaacccaaatggtatcacaataggtaaagaagcaattattaacactaatggctttactgcttctacgctagacatttctaacgaaaacatcaaggcgcgtaatttcacccttgaacaaaccaaggataaagcactcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaataaccatcagcgacataataaacccaaccattacttacagcattgctgcccctgaaaatgaagcaatcaatctgggcgatatttttgccaaaggtggtaacatcaatgtccgcgccgccactattcgcaataaaggtaaactttctgccgattctgtaagcaaagataaaagcggcaacattattctttccgccaaagagggtgaagcagaaattagcggtgtgatttccgctcaaaatcagcaagccaaaggtggtaagttgatgattacaggcgataaagttacattaaaaacgggtgcagttatcgacctttcaggtaaagaagggggagagacctatcttggcggcgacgagcgcggcgaaggtaaaaacggcattcaattagcaaagaaaacctctttagaaaaaggctcaacaattaatgtatcaggtaaagaaaaaggcgggcgcgctattgtatggggcgatattgcgttaattgacggcaatattaatgctcaaggtagcgatatcgctaaaactggtggctttgtggagacgtcggggcattacttatccattgacagcaatgcaattgttaaaacaaaagagtggctactggaccctgataatgtaacaattgaagctcctagcctttctcgcgctgacactgacattagttcagaatttccaatcggtgacggtactgaaaacagccctaaaaaaaacgccgacaaaacaatactgaccaatgaaaccatttcaaattttctgcaaaatgccaaagtgatgaacataacggcaaagagaaaacttaccgttaatagctcaatcagtatcggaagtagatcccacttaattctccatagtgaaggtcagggggacggaggcgttcagattgatggagatattacttctgaaggcggaaatttaaccattaactccggcggatgggttgacgttcataaaaatattacgcttggtacgggttttttaaatattaccgctgggggttctgtagcttttgagaaagggggcaataacgcacgtaacgcaacagatgctcaaattaccgcacaagggacgataaccgtcaataaagatgataaacaatttagattcaataatgtatctattaacgggacgggcgagggtttaaagtttattgcaaatcaaaataatttcactcataaatttgatggcgaaattaacatatctggaatagtaacaattaaccaaaccacgaaaaaagatgctaaatactggcatgcatcaaaagactcttactggaatgtttcttctcttactttgaatgacgatgcaaaatttacctttataaaattcgttgatagcggctcaaattcccaagatttgaggtcagcacgtagacgttttgcaggcgtacattttaacggcaccggaggcaaaacaaacttcaacatcggagctaacgcaaaagccttatttaaattaaaaccaaacgccgctacagacccaaaaaaagaattacctattacttttaacgccaacattacagctaccggtagcagtgatagctctgtgatgtttgacatacacgccaatcttacctctagagctgccagcataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaaggcaatctcacaatttcttctgacaaagtaaatatcaccaagcagataacaattaaagcaggcgttgatgagaaggattctagttcaagcacagcaagtgatgccaatctaaccattaaaaccaaagagttaaaattggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggtaacgtagaagtgacagccaaaacaggtgatattaaaggtgaagtcaaatccacttccggtaatgtaaatattacagcaaacggcgacacgcttaatgtaagtaatgtttcaggcaatgctgttaccatcactgcagataagggcaaattaaccacccaagaaagctctacgattagcggaactgagagtgtaaccacctcaagccaatcaggcgatattggcggtgcaatttctggtaacacggtaagcgttaaagcaaccaatgatttaattaccaaagcaaattcaaaaattgaagcaaaaacaggcgaggctaatgtaacaagtgcaacaggtataattggcggcacaatctctggcaatacagtaaatgttacagcaaatactggtagtttaactattaaaggcggtgcaaaagttgatgcgacaaatggagctgcaaccttaactgcagaatcaggcaaattaaccactcaagcaggctctactattacctcaaacaatggccagacaactcttacagccaaggatggcagtatcgcaggaagtattgatgccgctaatgtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 122 - DNA, 1341 bp, Haemophilus influenzae
atgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatcctgaacgaggattgggtaaagagcggttaattttagaagagaatttactgcaagtgcttgccgaatatgttaatggggatgcacgattagccttgaattgcctcgaattaatggtggatatggcagatgaaatggaaaatggaaagaaaattgaccgcactttattaaaagaagtcttaggcgaacgtcaagcgagatttgataaacaaggtgatcgtttctatgatttaatttctgcgctacataaatctgttcgaggttctgctccagacgctgcactgtattggtatgcaagaattttaacggcaggtggcgatcctttatatgtcgcgcgccgattacttgccattgcttcagaagatgtgggaaatgcagatcctcgtgctatgcaagttgcattggctgcttgggattgctttactcgagtgggggcttatgaaggagagagagccatcgcccaagccattatatatctcgcagtagcgccaaaaagtaatgcggtttatactgcatttaacacagcaaaacagcaagcgaaagatttgcccgattacgatgttccaccacatttacgcaatgcgccaactaatttaatgaaagagcttggctatggggctgaatatcgttatgctcacgatgaacctaacgcttatgcggcaggcgaaaattatttcccacctgaattaaaagatactcaatattattttccaacgaatagaggtatggaaattcagattaaggaaaaactagaacgattacgtgagcaagataaaagtacggtgaaaaaacggtataaataa

SEQ ID NO: 123 - DNA, 972 bp, Haemophilus influenzae
atggaaaatcccccattagtatcggttattgtttgtgcttataacgctgagcaatatatagatgaaagcatttcatccattattaatcagagttataaaaatctagaaattatagttatcaatgatggttcaacagatttgactttgtctcatttagaagaaatatctaaattagataaaaggataaaaattatcagtaataaatataatttagggttcataaattctttgaatataggccttggttgtttttcaggtaaatattttgcaagaatggatgctgatgatatagctaaaccatcgtggattgagaaaatagttacctatctggagaaaaatgatcatattacagcaatgggatcatacttagagattattgtagaaaaagaatgtggcattatcggttctaaatataaaactggtgatatatggaaaaatccattgctacataatgatatttgtgaagctatgcttttctataatccgatacataacaacactatgattatgagagcaaatgtatatagagagcataaattaatctttaataaagattatccctatgcagaagattataagttttggtcagaggttagtaggcttggttgtttagctaattatcctgaagcattagtaaaatatagactacatggaaaccaaacatcatcagtttataatcataagcaaaatgaggtagctaaaaagataaagggggaaaatattacatattaccttaataagataggtatagatataaaagtaattaatagtgtgtcgttgctagaaatatatcatgtggataaaagtaataaagtgttgaaaagtatactttatgatatgtatatgagcttagataaatatactataacttcactcttacattttattaaatatcatcttaaattatttgatttaaagcaaaattttaagattataaaaaaatttatcagaaaaataaatgttatgttttag

SEQ ID NO: 124 - DNA, 783 bp, Haemophilus influenzae
atgagtgttgagttaatgactaaagcatttaaaagcaaaaccggcaatcctttaacaaaattagtgctggtaaaattagccgataatgcgaatgatgatggcgtttgttatccaagttataaacgtattgcaatccaatgtgaagtttcgcgccctacggcaatttcgcacgttaagaaattggaagcgatgaaatatttatccattcgtgaacgtaaaaccgaaaacggcaacgccactaatgtgtatatcttgcatcccgaaaactgggaaatattagagccttttactagtaaagcagctttaccacccctagtaaacgagcttaaccaccctagtaaagcagctttaccacccctagtaaacgagcttaaccctgaaccatcaatagaaccatcagataaccatcatattaaaaaaactacgcaaaaaagcgaatccgaaatgttgcttgagcagttcggtattaccggacaactggcgaaagattttatcgcacaccgcaaagccaaaaagggcgtaattaaccaaacgcaactcaaccgcctgcaaaaacaagcggacaaggcggggatttcgatttgtgaagcggtggagatttgcattgaacgcaactggcagggatttaacgcatcatgggattggcgtgatgaaaaactgcgaccaaatttaccgcacttagggcaatcacaccccaacaaacccaaatttgacgatacgcagacaggctggtctgcaggaatgaatttcacagtggacggtacgcaatggcaaattccataa

SEQ ID NO: 125 - DNA, 2418 bp, Haemophilus influenzae
atgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattctgttgggctaatggtgctgggcggtattctctccgctgtatgggcgttattttccccattccgtgcatttttcggattgttgaaaggtggatttagatccgtaatgtttgtagccaaaccttttattaaggtagcgaaagggattgcatctccatttatctgggcgcaaaaacattttaaattattttcccgtgtcggcagtggcgcattctcgctgttgaaacgtggggcggtcaaatttacggtttatgggttgaaagcctttaaatggctcgctataaaaggtatcaatgggttctttggtattttgcgtgcggcggtcaaatttggcgtgatatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaa

SEQ ID NO: 126 - DNA, 2349 bp, Haemophilus influenzae
atgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacgtagcaaacggtcaaaatctacccgaaaatggggcatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatga

SEQ ID NO: 127 - DNA, 555 bp, Haemophilus influenzae
atgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgttcaagtaaataaatctttagccaaagaatggtttggtaaggcttgtgataatggtaatcaaaatggctgcgaatattatggcaagctaaatagaggggagctctaa

SEQ ID NO: 128 - DNA, 1848 bp, Haemophilus influenzae
atgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattattttgaaggggcagatttacccgcattagattttattggtggggctatcagtcactttaaagatgcagggaaaccagtgatcgcctatgcagataattattcacaaggacaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaa

SEQ ID NO: 129 - DNA, 1716 bp, Haemophilus influenzae
atgcatttacgtagtgaaggagctatgcgagatttgtttggctacttgccgaaatcggatttacaaagaacggctgcgatcatggcggatttacttaaacagccgaaaaatcagattctatctgccttaaagaaaggcagtaaactcgatgcttatggcctgattgatcgcgattatcgccccgatagtgtgcatgattatttagattggggcgaaaccttagattttgatgaatttgtgacacaaccattaaacgaaaacgtcctattaaaatcttgtacggaagtcgctcaagtgccaagtctgcaactggatgattttgaccatattgccggcatgaaagagatgatgttgacttatttgcaacaagcactaaaacatcatcgaaaaggcgtgaatcttttaatttatggcgtgcctggcactggtaaaacagaattcgccgggttgcttgcacaggcgttggggatttcggcgtataacattacttacatggattctgacggagatgttgtggaggcagagcaacgcctgaactacagtcgtcttgctcaaacgctattgaacggcaagcaggcgcttttaatttttgatgaaattgaagatgtgtttaacggctcgtttatggagcgttctgttgcacaaaaaaataaagcgtggacaaatcagttattggaaaacaataacgtgccgatgatttggttatctaactctgtttcgggcatagatcctgcttttttacgccgctttgattttattttagaaatgccagatttgccgttgaaaaataagtcagcactgattacgcaactgactgagggaaaattaagtccggcctatgtgcagcattttgctaaagtgcggtcattaacgccggcgattttaagccgcacaattcgggtggcaaaggaactcaatacatcaaattttgctgagactttgctcatgatgtttaatcaaacgttaaaatcgcaaaataaaccgaaaattgaaccgcttgttttaggcaaagccgactacaacttggattatgtggcttgtaacgacaatattcatcgtattagtgaagggttaaaacggtcgaaaaaagggcgaatttgttgctatggcccgccgggaacaggaaaaactgcttgggcagcgtggcttgcggaacagttggacatgccgctattgctaagacaaggctcagatttacttaatccttatgtgggcgggacagaacaaaatattgctcaagcctttgaacaagcgaaagccgataatgcaatattggtgctagatgaagtagatacgttcttattttctagagaaggcgcaaatcgaagctgggagcgttcgcaagtgaatgaaatgctaacacaaattgaacgctttgagggcctgatggtggtatcaacaaatttaattgaggttcttgatcacgcagctttacgccgttttgatttaaaattgaagtttgattatttaacgctcaaacaacgcttagattttgctaaacaacaagcagaaattttaggattgccgttgttatcggaagaggatttaagtcagattgaatcgcttaatctgctgacaccaggggattttgctgcagtggctcgtcgtcaccaattttccccttttcacaaggtgcaagattggctgatggcactacaaggggaatgtgaagtgaaaccagcgttttctgcaacgacaaggcggatagggttctaa

SEQ ID NO: 130 - DNA, 576 bp, Haemophilus influenzae
atggagaaaataatgaaaaaattaacattagcattggttttaggttcagctttagccgtgacaggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaataa

SEQ ID NO: 131 - DNA, 1194 bp, Haemophilus influenzae
atgtcagacacacttcttaacccttattttggcgaatttggcggaatgtatgtacccgaaattttagtgcctgttttgaagcaattagaacaagcctttgtggaggctcaaaatgatcctacattccaagcagaatttgctgatttactcaaaaattatgcgggcagaccgaccgcacttactctttgtcgtaacttaaccaaatgcacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaaccgccctagcttgtgctatgttagatatgccgtgtcgtgtttatatgggtgcaaaagatgttgagcgtcaatcaccaaacgtgttccgtatgcgtttaatgggggctgaagtaattcctgtagaaaaaggctcttgttctttaaaagatgcctgttgtgaagcgatgcgtgattggtcagcaaactatgaaaccacccattatttacttggaacggcggcaggccctcaccccttcccgacgattgtgagagaatttcaaaaaatgattggcgaagaaaccaaacgtcaaattctagaacgagaaggtcgtttacctgatgctgtgattgctgcggttggcggtggttctaacgcaattggtatgtttactgattttattgatgaaccaaatgtgcgtttaattggtgttgaacctgcagggaaaggcattgaaagcggtgaacatggcgcaccattaggtcatgcaaaagtgggcatttatttcgggatgaaatcccctttaatgcaaaccgaagatggtcaagtagaggaatcttactctgtttcagctgggttagacttcccttctgtcgggccgcaacatgcttatttaaatgagattggtcgtgctgattatgtatcgattaccgatgaagaagcccttaacgcattccaagaattggcaaaacacgaaggcattattcctgcattagaaagctcacacgccttggcttatgccttgaaattgattaaacaaaatcctgaaaaagaacaacttttagtggttaatctttcaggacgaggcgataaagatatttttactgttgataaaattttaaatggaggaacgaactaa

SEQ ID NO: 132 - DNA, 837 bp, Haemophilus influenzae
atgaaaaagacattgattacaggattattggttttagctggcacagcacaagctcatgaagtttgggttcaagcaccgacgaaattaacatctggttctgtattaaaagcagaattagcttatggggattacccttatgtagaaaaaattcctgaagcacgtttaaaaatttttgcaccaatggaaattattcgtcaagatggagaaaaacaaaccttaatccaaaaaggcgaaaactatcaatatcaatcagagaaagcattgtccgatggttcttattgggtaacagcgacttataaacctactttttggtcacaaaatgctgaaggttggaaaatggataatttgaaagaattagaaaatcccacttattgtgaacaaactcaaatgtttggcaaaagtcttgttaccgttggtaaaaaaccattaaatgcagaaatggcaatgacaagagttggtttaccactggaaattgttcctttgcgtgatcctagcaaagcgaaatcaggcgaaccgttccctgttcaaattttctaccaagatcagccattagcaggcgaaactgtcatcgcaaccgctgatactattatcgtgaaagatcttgaagcaagtacaggtcatcgtgaaccacaaggtttttcaggtaaaacagatagtcaaggacgtgtgaatatcattccattaattgatggtatttggaaaattaaagttattcataaaacaccatttgcagatcaacaaatttgtcagcaatctgcaagctatagcacattaattttaccggttggtaaaggattagctaaactacctccaaaaccagaacaccatcatcactaa

SEQ ID NO: 133 - DNA, 825 bp, Haemophilus influenzae
atgacaaaaaaatacgatttacattgtcatagtaccgcatcagatggagtgttgagtccaactgaattagtgcatcgtgcttatgcgcaaggtgtgaacgtgctggcattatgcgatcacgatacgattgtgggtattgatgaagctgagattacagcgaaagaagtaggcattgaattgattactggagtagaaatttcgacaaattgggaagggcgagggatccatattgtaggattaaacttcgataaaactcatccaaaaatgaccgcacttttgcaaagtcaaaaagcattacgggaaaaaagagcggtggaaattggcgataaattagaaaaagcagggattcctcatgcttatgacggggcaaaagccttagccgatggcgaagtgacgcgtgctcattatgcacgttatttggtgcagattggtaaggtatctaatgatggtcaggcctttaaacgctatttagggcaaggaaaatcagcatttgttaaagctgaatgggctgatattcccacggcgattgagacaatccatgccgcaggcggtatagctattattgcacatccattacgttataacatgacggggaaatgggtgcgtaagctgatagtcgattttaaggcttggggcggtgatggaatggaaatggcggattgtggtcaaacaaaagatcagcgtcaaatgcttgctcgttgggcaaaagaatttaatctgctgggatccgttggctccgattttcatttcccttgtggctggattgagttaggaaaaaatttagatttagttgatagcgttatcccagtttgggaaaaattttag

SEQ ID NO: 134 - DNA, 2865 bp, Haemophilus influenzae
atgacacaaaaattcgaaatggcagaccgttttaatccgtctgcggtagaacaagccctttatcaacattgggaagagagcggttattttaaaccgtctgaaaatgaaaatgcgccgagctattgcattgcaattccgccgccgaacgtaacaggttctttacatatgggacacgcattccaacaaaccttaatggataccttaatccgttttaaccgtatggaagggcataacaccttatggcaagcggggacagaccacgcaggtattgcaacccaaatggtggtggaacgtaaaattgcggctgaagaaggcaaaactcgccacgattatggtcgtgaagcgttcatcaacaaaatttgggattggaaagcttattcaggtggcacaatcagccaacaaatgcgccgtttagggaactcaatcgactgggaacgtgagcgtttcaccatggacgatggtttatcgaatgcagtaaaagaagtgtttgttcgtttgcacgaagaaggtttgatttaccgtggcaaacgcttagtaaactgggatccaaaacttcacaccgcaatttctgatttagaagtagaaaacaaagagagcaaaggctccctttggcatttccgttatccgttagcaaacggtgcaaaaacggcagatggtaaagattatttagtggtggcaaccacccgtccagaaaccatgttgggcgatacggctgttgcagtgcatcctgaagatgagcgttatcaatctttaattggtaaaactgttgttctaccactggctaatcgtgaaattccgattattgccgatgaatatgtggatcgtgaattcggtacaggtgtcgtgaaaatcaccccagcacacgatttcaacgactacgaagtgggtaaacgtcataacttaccaatggtaaatgtattgacgctgaacgcaaatattcgtgatgaagcggaaattatcggtactgacggcaaaccacttgctggctatgaagcgacaattcctgcggattaccgtggcttagaacgttttgctgcgcgtaagaaaattgtcgcagattttgaagcactgggtttattagacgaaattaaaccacacgatttgaaagtgccttatggcgaccgtggcggtgtgccaatcgagccgatgctaactgaccaatggtatgtgagcgtgaaaccgcttgctgatgtagcaatcaaagcggtagaagacggcgaaatccaattcgtgccgaaacaatatgaaaacctttacttctcttggatgcgtgatattcaagattggtgtatttctcgccaactttggtggggacaccgtattccagcgtggtatgacgcagaaggtaacgtttatgtcgcgcgtaacgaagaagaagtgcggtcaaaatacaacttagattctgcggttgaactcaaacaagatgaagatgtgttagacacatggttctcatcaggcttatggacgttctctaccttaggttggccagagcaaaccaaagagctcaaaatgttccatccaacggatgtgttaatcacaggcttcgacatcatcttcttctgggttgcgcgtatgattatgtttacgatgcactttgtgaaagatgaaaatggcaaacctcaagtgccattcaaaactgtgtatgtaacaggcttgatccgtgatgagcaaggtcaaaaaatgtcgaaatcgaaaggtaacgtacttgatccaatcgatatgattgacggtatcagccttgaagatttacttgaaaaacgcactggcaacatgatgcagccgcaattagcagagaaaattgccaaagcaacccgtaaagaatttgcggacggcattgctgctcacggtacagacgcattgcgttttacattagcggcgttggcttcaaatggtcgtgatatcaactgggatatgaaacgtttagaaggttaccgtaacttctgtaacaaattgtggaatgcaagccgtttcgtcttaacgaatgaaaaattagatttaagtgaaggcgagatcgaattctcattagcggatcgttggattcaatcggaattcaatcgcacagtggaaacgttccgtaattcattaagccaatatcgttttgacctttgtgctaatgcaatttatgaatttacctggaaccaattctgcgactggtatttagaattgactaaaccagtatttgccaacggcaacgcagcacaaatccgtgcagcaagccaaaccttggttcacgtgttagaaaaattattacgtttagcacatccgcttattccatttattactgaagaaatttggcaaaaagtgaaaggttttgtcggcattacggctgacagcattatgttgcaacctttcccacaagtggaagagaacggctttgatctagaagcagaagctgaaattgagtggttaaaagaagtgatcgttgcggtacgtaatatccgtgcagaaagcaacatcgcaccaagtaaaggcttagatctgttattccgtaatttaagcgcagagaatgcaaagattcttgaaaaacagaccgctcttttgaaagcaatggctaaattagataacgttcaagtgttagctgcaaacgaagcagcaccgcttgcggtagcgaaactcgttggcaatgcggaattactcgtgccaatggctggctttatcaataaagaagcagagcttgcccgtttaaccaaagagattgaaaaatatcaaaacgaagttaaacgcatcgagaataaacttagcaatgaatcttttgtggctaaagcacctgaagcagtgattgcgaaagaacgagaaaaacaagcggaataccaatctggattagaaaaaatccaagagcagtataaggcgattgaggcattgtaa

SEQ ID NO: 135 - DNA, 1020 bp, Haemophilus influenzae
atgtttatgcataaaatgaaaaaaaatcttattatcgttttaaccttaggtacgttaccttttgctcaagctaatagcatcactggtgctggagcgtctttcccttatccaatttatgcgaagtgggcatctttatatgagaaagaaactgggaataaagttaattatcaatccatcggttcgggcggcggacaacagcaaattattgcaaaaacggttgattttggtgcctctgacgatccaatgaaatccgaattattacaacaacaccaactagtccaattccctgcggttatcggtggtatagtgcctgttgttaatttgcctgaaattaaacctggtaaattaaagttatcaggtaagctgttagcagaaatcttccttggtaagattaaaaaatggaacgatcctgacttagttgcattaaatccaacgcttcctttaccaaataaaaacattattgtgattcatcgttcagacggctctggaacaacatttggcttcactaattatctatctaaagtttcgaacgattggaaaaatcaagttggtgaaggtaaatcagtgaagtggttaacaggtcaaggtggaaaggggaatgagggagttgcttcttatgttcgccaaatgaaatacagcattggttatgtagagtatgcctatgccaaacaaaatcagcttgcttggatttcattacaaaatcaagcagggcaatttgtacagccttctaatgaaagtttcatggcagctgcaagtcacgcaaaatggcacgaaaaggcaggaatgggtgttatattaaccaatgaaacgggggaaaaatcttggccaattacggcggcgagttttattttattaaataaatattctgacaatcctgaaacaactaaaaatgtattagccttttttgattgggcattctcaagagggcaagatgcggcaactgaattagattatgtgccaattccagctgatgtggtgtctaccattaaaagtcaatggaaaacagagctaaaacaataa

SEQ ID NO: 136 - DNA, 4533 bp, Haemophilus influenzae
atgtctgatgtttttgaattagaaaatgaaatcgaattagagagcgatgaagtcattatggaaaatgaaaacgtcgaagaaatcgttgacgcacctatgccttttagcatgacgacaaataatggtgtagagcgtggtaaattccgttctttaaccttaattaactggaatggtttttttgcccgtactttcgatttagatgaattagttaccacgctttctggtggtaacggtgcaggtaaatcaaccacaatggctggatttgtgaccgcattaattcccgatttaacccttttacatttccgtaatacaacagaggctggctccacaggcggttctcgcgataaaggtttacatggtaaattgcgtccaggtgtttgttacgcggtattagataccattaactcacgtcatcaacgtattcttgtcggtgtgcgtctgcagcaaattgcgggtcgtgataaaaaggttgatttaaaaacgttttcaattcaaggtgtagaattatctcaaaatccgaccgcacttttcacagaaaccgtgggcgaacgtcaagctcgcgtccttaatttaaacgaactcaaagataaaattgaaaatatcggtgcacaatttaaacaatatcattccatcaccgattatcacggcatgatgttcgatttaggtattattccgaaacgtttacgttcagcatcagaccgaagcaaattctataaacttatcgaagcatctttatacggcggtatttccagtgcaatcacacgctctttacgtgactatttattgccagaaaatttaggtgtgcgcaaagctttccaagatatggaaagtgcattgcgtgagaaccgtatgactttagaggcgattaaggtcacgcaatcagatcgcaatttatttaaacatttaattactgaaaccactaattatgttgcttcggattatatgcgtaatgcgaatgaacgccgtggcaatattgaggctgcattagaatctcgtcgcgagtggtataaagcaaaagcagagcagaatttatctcaacatcgtttagttgatttaagtcgagaagcggctgaattggcagaaaatgaacgtactttagaagttgatcaccaaagtgcggttgatcatcttaacttagtgttaaacgctttgcgtcaccaagaaaaaatcacgcgctatcaagaagatattgcagaactcaccgagcgtttagaagaacaaaaaatagtggttgaagatgcgaatgatgcgttagaagaaagccaagcccaatttgagcaaactgaaattgaaattgacgctgtacgagcgcaattagcagattatcaacaagcattagatgcccaacaaactcgcgcacttcaatatcaacaagccattactgcactcgaaaaggctaaaaccttgtgtggcttagctgatttaagtgttaaaaatgtagaagattatcacgcagaatttgaagcccatgctgaaagtttaacggaaactgtgcttgaacttgagcacaaaatgtctatttctgaagcggcaaaatctcagttcgataaagcgtaccaattagtatgcaaaattgccggcgaaattccacgctcgagcgcgtgggaaagtgcgaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgcagagcaagaagcgttgattgaagatatttcagcaagactttcagaacaagtggaaaaccgttctacgcttcgtcaaaaacgtgaaaatttaaccgcactttatgatgaaaatgcgcgtaaagcaccagcatggctgacagctcaagctgcattagaacgtttagagcaacaaagtggcgagacgtttgaacatagccaagatgtgatgaactttatgcaatcacaacttgtgaaagaacgtgaactcacgatgcaacgtgatcaacttgaacaaaaacgtttgcaattagatgagcaaatttctcgtttaagtcagccagatggttcagaagatccgcgtttaaatatgctggcagaacgttttggtggtgtactgctttcagagctttacgatgacgtaaccattgaagatgcgccttatttctccgcactttacggacctgcacgtcatgctattgttgtgcgtgatctcaatgcagtgcgtgaacaacttgcgcaattagaagattgccctgatgatttatatttaattgaaggcgatcctaccgcatttgacgacagcgtattgtccgcacaagaacttgagctaggtgttgtcgtgcaagtttcagatcgtgaattacgctattcaagattccctgaaattccattatttgggcgagcagcacgtgaaaaacgtttagaagaattacaaattgaacgtgatgaagtggcagaacaatatgcccaaattgcgtttgatgtacaaaaatgccaacgtttacacgaacatttcagccaatttgttgggttgcatttggcgctggcattccagccaaatccagaagagttaatgtctgagattaatcgcgaacgtaatgaaattgatcgtgaattaaatcaattcaataacggcgaacaacaattacgcattcaattagataatgcaaaagaaaaactacagttactcaacaagttaattccacagctcaatgtattgactgatgaagatttaattgatcgtattgaagaatgtcgtgaacaattagatattgcagagcaagatgaatattttattcgtcaatatggcgtaacgttgtcacaattagagccgattgccaatagtttacaaagtgatccagaaaattacgacggcttaaaaaatgaattaactcaagcgattgagcgtcaaaaacaagttcaacaacgtgtatttgcgttagctgatgttgtacaacgtaaacatcattttggttatgaagatgcagggcaggctaaaacttctgaactcaacgaaaaacttcgccaacgtttagaacaaatgcaggctcagcgagatatgcaacgtgagcaagttcgtcaaaaacaaagtcaatttgctgaatataatcgcgtattgattcagttacaaagctcttacgatagtaaatatcagcttttaaatgaattgattagtgaaattagcgatcttggcgtgagagctgatgatggtgctgaagaacgcgcgcgtatccgtcgtgatgaattacatcaacaactttcaacgagccgtcagcgtcgttcttatgtagaaaaacaactcacattaattgaaagtgaagcggacaacttaaatcgtctaatccgcaaaactgaacgcgattataagactcaacgtgaattagtggtagcagcgaaagtgagttggtgtgtagttttacgtctatcacgtaattctgatatggaaaaacgcctcaatcgccgagagctcgcttatttatctgcagatgagttacgttcaatgtcggataaagcattaggtgcgttgcgtacagcggtggcagataatgaatatctacgtgatagcctaagagtgtcggaagatagtcgcaaacctgaaaataaagtgcggttctttattgcggtgtatcagcatttacgtgaacgtattcgtcaagacatcattaaaacggatgatccaattgatgccattgaacaaatggaaattgagctttctcgtttaacggctgaattaactggccgtgagaaaaaattggcgatcagttctgaaagtgttgcaaatattatgcgtaaaacgattcagcgtgaacaaaatcgtattcgtatgctcaatcaaggtttgcaaaacatctcgtttggtcaagtaaaatctgttcgtttggtagtgaatattcgtgatacccatgccatgttgttggacgcactttctggtcagcaagatgaatatcaagacttatttaacgacaactgcatcaccttttctgaagctatggcgaagctctatcaacgtatcaatccacatattgatatgggacaacgcacagcacaaacaatcggcgaagaattgttagattaccgtaattatcttgaacttgaagtggaagtattccgtggcgctgatggttggttacgcgctgaaagtggcgctctttctactggtgaagctatcggtacaggtatgtcaattctcttaatggttgttcaaagctgggaagaagaaagtcgtcgaattcgaggcaaagatattgtgccttgtcgcttgttgttcttagatgaagcagcgcgtttagacggtaaatctatttctaccttattcgaactttgcgaacgtttggatatgcagttgcttattgctgcgccagaaaacattagcccggaaaaaggaacaacctataaactcgtgcgtaaaatcgcaggcaaccaagagcatgtacacgttgttggtttacgaggattcggtgcgacagaataa

SEQ ID NO: 137 - DNA, 2193 bp, Haemophilus influenzae
atgacaaccgcagtaacacaagcaactattgatggtttttttgatgcgagcaatggtgatccttttgctacgcttggtatgcacgaaaccgagcaaggaattgaaatccgtacgttattgccagatgccaatcgaatggtggtgattgagcgtgaaagtggtaaagaaataacggaactggattgtgtcgatgagcgtggattttttgttggtgttattccaaattgtcgtcaattttttgcttatcaattacaggttttttggggtaatgaagcacaaattatcgaagatccttatcgttttcatccaatgattgacgatttagaacaatggctactttctgaaggatctatgcttcgcccatatgaagtgcttggtgcacattttatggaatgtgatggtgtgagcggggtgaatttccgcttgtgggcacctaatgcaagacgagtttctattgtaggcgatttcaactattgggatggtcgccgccacccgatgcgtttccacccgaaaagcggtgtgtgggaattattcctgccgaaagccagccttggtcagctctataaatttgaattgattgattgctatggcaatcttcgtttgaaagcggatccttatgcctttagttcgcaacttcgccctgatacagcttcacaaattagtgcattaccaaatgtggtggaaatgacggaacaacgtcgtcaagcaaatcaagcaaatcaaccgatttctatttatgaagtgcatttaggatcttggcgtcgtaatttagaaaacaatttttggctagattacgatcaaattgctgatgaattaattccttatgtaaaagagatgggctttacccatatagaatttttaccgctttctgaatttccgtttgatggttcttggggctatcaaccacttgggctttattcgccaaccagtcgttttggctcacctgaggcatttcgccgtttagtaaaacgtgctcacgaagcaggcatcaacgtgattttagattgggtgccagggcatttcccaagtgatacccatggtttagtcgcatttgatggcacagccttgtatgaacatgaagaccctcgcgaaggctatcatcaagattggaataccttgatttataactatggacgcaacgaagtgaaaaatttcctgtccagcaatgccctttactggcttgaacgctttggcgtagatggtattcgcatggatgctgtggcttcaatgatctaccgcgattacagccgtgcggagggcgagtggattccaaaccaatacggcggacgtgaaaatttagaagccattgagtttttaaaacacaccaactggaaaattcacagcgaaatggcgggagcaatttctattgcggaggaatctacctcttttgcaggcgtaacccacccaagcgaagacggcggcttgggcttcaatttcaaatggaatatgggctggatgaacgatacactggcttatatgaagcttgaccccatttaccgccaatatcatcacaacaaaatgacctttggaatggtatatcaatacagcgaaaattttgttctaccactttctcacgatgaagtggttcacggtaaatattcacttcttggcaagatgccaggcgatacgtggcaaaaattcgctaacttgcgtgcatattacggttatatgtggggctacccaggcaaaaaattgctctttatggggaatgaatttgcccaaggtcgtgagtggaattatgaagaaagtttggactggttcttgcttgatgaaaatattggcggaggttggcacaaaggcgtattgaagctggttaaagacctcaatcaaatttatcaaaaaaatcgaccgctctttgagctcgacaactccccagagggtttcgattggcttgtcgttgatgatgcggcaaattctgtgttcgcctttgaacgtcgcagttcaaacggagaacgtattattgtcgtcagtaactttacccctgtgcctcgccacaattaccgcatcggcgtgaatgttgcaggaaaatacgaagaaattttaaataccgattcgatgtattacgaaggttcaaacgtgggcaattttggttgtgtcgcaagtgaaaaaatcgaaagccacggacgagaaaattcgatttcagtgtccattccgccgttagcaacagtttatttgagattgaaggcgaaataa

SEQ ID NO: 138 - DNA, 1674 bp, Haemophilus influenzae
atgatgagccatacagagacatctttgggtgcagaaaatacccgcactcataattttattacccaaattattgatgaagatttagcttcgggtaaacataaaagcgttcatacccgttttccgccagagccgaatggttatttgcatattggtcacgcaaagtctatttgcttgaattttggcttggcaaaagaataccaaggtttatgtaacctacgttttgacgataccaatccagtaaaagaagacgtggaatatgtagattctatcaaagcggatgtggaatggttaggttttaaatgggagggcgaaccgcgttatgcatctgattacttcgatgcgctttatggctatgccgctgaattaattaaaaaaggtttggcttatgttgatgagctttctccagatgaaatgcgtgaatatcgtggtaccttaaccgaacctggtaaaaacagcccatatcgtgaccgcactattgaagaaaacttagcgttatttgaaaaaatgaaaaatggcgaatttgccgagggtaaagcaagtttacgtgcaaaaattgatatggcttcgccatttatggtcatgcgtgatccagtaatttatcgtattaaatttgccagccatcaccaaacaggtgacaaatggtgtatttacccaatgtacgatttcacgcactgtatctctgatgcgattgagcgtattacacactcaatctgtacattagaattccaagataaccgtcgtttatatgactgggtgttggaaaatatcagtattgaacgtccattaccgcatcaatatgaattctcacgtttgaatttagaaggcactttaacctctaaacgtaaattattgaaattggtaaatgatgaaatcgtggatggttggaacgatccacgtatgccaaccatttcaggtttacgccgtcgtggttatacaccagcttcgttacgtgaattttgtcgtcgtatcggtgtgactaaacaagataacgtcgtagagtattcagcacttgaagcctgcattcgtgaggatttaaatgaaaatgcaccacgcgcaatggcagtgattgatcctgttcgtgtggtaattgaaaattttgaaagcgaagcggttttaactgccccaaatcatccaaatcgtcctgaattaggggaacgtcaattgccgttcacgaaagaactttatattgatcgagctgacttccgtgaagaagcgaacaaacaatataaacgcttagtattaggcaaagaagtgcgtttgcgtaatgcttatgtgattaaagctgaacgtgtagaaaaagatgcaaatggtgaaatcaccacgatcttctgtacttacgatcctgaaactttaggtaaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaa

SEQ ID NO: 139 - DNA, 879 bp, Haemophilus influenzae
atgcaagaacttattaagcgcaccttgccacaagatgatgcacttaatcaagctattgtgaatgaacttcgttcacaaaattgggctggttttttaaattattcccaagtgcagcagctttgtcataattttgaacttaccccactaaaattggctatgcacttgttgccacttgctgcaagttatagtcatactgctatttctcattttaatgtgggggcaattgctattggcgaacaaggggatttttatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatgaattgcacggtgctgaaaaaatttcaattcatttgccgcatagccaaaataatccattacattcttatttaccggatgcgtttgggccaaaagatctcgatattgcagcgcatcttttggcggaagaaaatcatgatttagttgctgatcatcaagatgatttggttaatcaagctattttagcggcaaatcaatctcattgtccttattcaaatagtccgcacggcattgcgattttatttaaaaatggtgatgtggtgacaggacgttatgcagaaaacgccgcatttaatccgagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcagtagaattagagtattattctttgtaa

SEQ ID NO: 140 - DNA, 1386 bp, Haemophilus influenzae
atgcagaaaaacgaaataaaacaaagcgatatgaaaccacttatcattgattcttcttggacagaacgttttcttcctgatcctccacgcgaaaaagataatcgcccaccatttcgtcgggatcgtgggcgaattttacattctgccgcttttcgttgcttacaagcgaaaacccaaattcacgcaattggcgaaaatgatttttaccgtactcgcttaactcactctttagaagttgcacagattggcagcagcctcgttgcacagcttaaatttttagaaacctttgaaagcctttcgcaaacattaaatattgataaaaacgagttgcaaaaacaattaaaacctttattgccgagtaacgatcttattgagagtttgtgttttgctcatgatattgggcatccgccttttgggcatggtggcgaaacggcattaaattatatgatggcagagcagggagggtttgaaggcaatgcacaaacctttagaattttaacgaaacttgagccttacactgaaaatgcagggatgaatctaacgcgccgaacactattgggtgtagtgaaatatcccgcgttgttaggtgtggcttcgcctcaatatgcagaacttaatttttctcgcaacattgatcctcgttttgtgcgtattcatgattggattccaggaaaaggcattttccgcgatgatttaaaaatgtttaattggttgctggaaaatctttctgaaaatgaccgcactttattctgtcaatttaaaaaagtgcgggaaaatccagctgaatctttacatactcggtttaaatcactggattgcagcattatggaattggcggatgatattgcctatggcgtacatgatttagaagatgcgattgtaactggcgtggtaaatcctcatcaatggcaagcggcacatgttgcattgaaacaaattccgtcagcttggttacatgaaaatattgattcaattagccaacgacttttctcggataaacattttgagcgcaaacaggcgattggtgcattggtgaacttttttattactaatgtgcggtggaaattaacggcaaattttgatgaacctttgttacgttataacgcagagttgccacctgaagtgattgctgcgcttggtgtatttaaaaaattcgtttgggattatgttattcgcaatgtggatacccaacgaatcgaatataaagggcagagaatgctaacagaaatgttccagatttttgaatctgatccggagcgtttattaccaagaaatacagaaaatcgttggcgtaatgcaccaaaagaagggaagaagcgaattatttgcgattatattgcaggcatgtcagatgcacacgcattgcgggtatatcaacaactttga

SEQ ID NO: 141 - DNA, 1671 bp, Haemophilus influenzae
atgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttggggtggtaaattctcaggcgtggcaaaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgacttacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaa

SEQ ID NO: 142 - DNA, 765 bp, Haemophilus influenzae
atgggatggggtggaattttaggtgcgatgacacaaggattgggaactggtattgtcaaaaatgttgagcaagggtggaaagatgaagaaactcaaaagttgttagattggaaaacggcagaagccgacaaacaacgtgcttttgatagtgaattgcttgataaaaaatacaagcacgagtttgagcttgaagatcatagaacccgtaatgaaatttcagcggcggctgcaaaagctcgaatttcagcacgttattctcatggtggtgaatcagaagcgcaaaaaaatcttcttggcgcaactcaaacgcttggtatttatgatagccaattacattccttgcaagaaaaattgtccgcaacagaagataaagagcaacaaaatgcgattgcagcaagaatcaatgctgtttctgctgaacgcgagaattatcttaaacgccctgatacaatcgctgcatttaagggggctggccagatgggacaagcgctttatatgactggtggtggtaatatggatttgtacaatccgaaaccagtggagcgcgaaacggtagctgaggatgttaaatcttctgtcgctcctcctgtgcgcaatatgattgatgtaaataatctcactccacaacaggcggcagatattgcaagacagaaaagtgaagatgccgctcgtttgcagttttccaaagcgtcagcggatgctaaagactgggcgcaaaaacgtacacagtatcaatcatcaactttcattccgcgaacattctaa

SEQ ID NO: 143 - DNA, 2523 bp, Haemophilus influenzae
atggcatcacaatattttgcaatcttaaccgactacggaacacgtgctatcgctcacgcattaagccaagggcaaccgttacagctcacccaatttgcagtgggtgatggcaatgggaaagcggtcacaccaacggcgaacgcaacagctctcgtacatcaaacgcacattgcacctgtcagtgccgtctctctcgaccctcgcaataataaacaagtcatcgttgaattaaccatccctgaaaatatcggcggtttttacataagagaaatgggcgtatttgacgcacaaaacaaactcattgcctacgcaaactgtcctgaaagttttaaaccgacagaaagtagcggaagtggtaaagtccaagtattgcggatgatcttaaaagtagaatcttctagtgcggtgacattatctattgataacagtgtgatttttgtcacccgacaacaaatgacaccaaaaaccattactgccacaacgcaaaatggatttaatgaaagcggacacagccaccaaatagccaaggcaagcaccacacaacaaggtatagtccaactcaccaacgacacagggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagatggaaaggttggtttaaatggtaacgaaagcattaatggcgagaaatcctttgaaaatcgtattgtggcaaaaagaaatatccgtatttcagacagccagcattatgcttcacgcggagactatttaaatatcggggcaaacaatggcgattgctggttcgaatataaatcaagcaaccgagagattggcacgcttcgtatgcacgctaacggcgatttaacctacaaacgccaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacttagcaagcggtcaaaatctacccgaaaatggggaatggcatattgaagtagttagcggtggggcaacaaatgcggtgcgtcaaattgcacgtaaagcgaatgataacaaaatcaaaacacgcttttttaatggttcaagttggtcagaatggaaagatgcaggcggcgacggcgtgcctattggtgcagttgtatcattccctcgtgcggtaaccaatcccgttggttttttacgtgctgatggttcaacattcagccaacaaacctttcccgatttataccgcactttgggcaacagcaacaaactccctgatttaacccgtagcgatgtggggatgacggcttattttgccgtggataatatccctgcaggctggattgcctttgacgagattgccacacaagttaccgagcaacgttaccctgagttatatcgtcacttggtcggtaaatatggttctatttcaaatgtgccacttgcggaagaccgatttattagaaatacagggaatgggttaaatatcggtcagacacaaagtgacgagattaaaaagcacgttcacagagtgagaacacactgggctgattcatctgatagtagtattttttatgacaaaacgaaaactgttatagattcacgattatgcactgcaactacaaccgatgataatctcagtgataatggatttatgcatccgcttttagataccccgatggcaacaggtggagatgaaactcgccctaaatcgcttattctcaaactttgtataaaagcaaaaaacacatttgatgacgtgcaattttgggttaaagcattcggcgttgttgagaacgcaggaattttagatgcgggtacacttgtgcaaaatatgcaagcgttatctgcgagggttgaccaagaaataaaagaaaataaacaatctactttacaagaaataaacaatgcaaaagttgatataaatcagcaatttttgcaggcacaaaagaatttatctcaaattggcacattaaaaacagtgtggcaaggtaatgtaagttctgggagtattaatatttcagaaaagtgttttggtaaaacacttattttgtatcttcagtcatcatcaggccacaggcttgatgataataacaatattgaaattgtcagttttgaagtaggggcagagattgaaggtaaaaggggcggtggagtttattttagtagtattcgtcaagtaattccacacagttctggtggaactagtgtgtatcatgtagaagtcgaggaattcgctgtgactgttgatagaaacggtacaacaatacacattgaagaacttgctggtcgttttgtaaaacgtattgatattcgatga

SEQ ID NO: 144 - DNA, 1050 bp, Haemophilus influenzae
atgaataaatttaccaaacaaaaatttaatacttaccttgctggtgttgcacaagataacggcgaagatgttgcttttatcgcaaatggtggtcagtttaccgttgagccaactattcaacaaaaattagaaaatgctgtgcttgaaagttctgatttcttgaaacgcatcaatgtagtgatggtgcaagaaatgaaaggttctgcattgcgtttaggtgtgctttcaccagtggcaagtcgcaccgacaccaacaccaaagcacgtgaaaccactgatattcacagcttgcaagaaaacacctattcttgcgaacaaaccaactttgacacacatttaaattatccaaccttagacagttgggcgaaattccctgattttgccgcacgtgtgggcaaactcaaagcagaacgcattgcattagaccgtatcatgatcggttggaatggcacaagtgcagcaacaaccacaaaccgtacctcaaatccattattgcaagatgtgaataagggttggttagtccaaatcgaagataaagccaaagcccgtgtgttaaaagaaattgaagaaagcagtggcaaaatcgaaatcggcgcaggtaaaacctataaaaatcttgatgcccttgtctttgcattaaaagaagatttcattccagcgcaataccgtgacgatacaaaactggttgcaattatgggtagcgacttattagccgataaatacttcccattaatcaaccaagaaaaaccaagcgaaattttggcaggcgataccgtcattagccaaaaacgtgtgggtgggttacaagccgtatctgtcccattcttcccgaaaggcacagtgttagtcacatcgcttgataacttgtcaatctacgtgcaggaaggcaaagtacgtcgtcacttaaaagatgtaccagaacgcaatcgtgtggaagattatttatcgtcaaacgaagcctatgttgtggaaaactacgaggcagtcgccatggcgaaaaatatcaccattcttgaagcacctacgcctatttcgccagtggctgcataa

SEQ ID NO: 145 - DNA, 1392 bp, Haemophilus influenzae
atgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccgtgcaattacaagatgggcgtgaatttaaagcaaaattagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataa

SEQ ID NO: 146 - DNA, 969 bp, Haemophilus influenzae
atgaaaaaatataaaactgggctcgtgttattagtgattgcactcgccttacttgtctatttttccccttggtttttcttacatattgccagttggcaaaaagagtttaatcagcttatttcggaaaatttacatcaaattcaaaataatagcatcaaggcaggcatcacacttattttcgtcagctttatttatggcgtactccatgccctcgggccaggacacggcaaatttattattgccagctatctttccacgcatgaaagccaattaaaacaaagcactatcttgagcttactttcatccttaatgcaaggcattgtcgcgattacagcaacaacattgcttgttgtagtgctaaatctttcatcacgttatttcaaattaagccagctttggttagaacgaactgccttgctattattggtatttctcggctgttattggatttggcaaggtctacgtgcctatcgtaaaaaagctaaattaaccattaaatccctcaatcccctccctctacacgaaaaaagtgcggtgaaaaataaccgcacttttcagccaaacacttgtagctgtggacaccaacatttgccaagccccacgcaaactgcacaagcaaccaatctaaaatcacaattcctcgtgattctaacaattggcatgcgcccatgtagcggtgcaattttcgttttatttttagcttatatgcttgatctttatagctggggaattttagctgtattagccatgtctttcggcacggggcttatgctgtcagccttcgcaggaattgtacgttatgcacgaaataccgcaatccacttagggcattggtatagttcaaaaaatacgaaaggaaaaagcgaaagcatcgtgaaactaatcgctggtggaataatgctattttttgccttgagcttgttatacggcacaaccatctcaactggcggaagcaaaatcctattttga

SEQ ID NO: 147 - DNA, 663 bp, Haemophilus influenzae
atgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgccggtgtttaattaccaagaactcacatcggaagaacaagataagctgccaaataaaaagaaataa

SEQ ID NO: 148 - DNA, 1908 bp, Haemophilus influenzae
atgggaaaaattattggtattgacttaggtacaacaaactcttgtgtagctgtaatggacggcgataaagcgcgcgtaattgaaaatgcagaaggggcacgtactactccgtcaatcattgcatatacagataatgaaaccttagttggtcagccagcaaaacgtcaagcaatcactaacccaaaaaatacattgtttgcgattaaacgtttaattggtcgtcgttttgaaagtgaagaagttcaacgcgatattaaaattatgcctttcgaaattactcgtgccgacaatggcgatgcttgggtaaacgtgaaaggtgataaattagccccaccgcaaatttcagcagaagtgttgaaaaaaatgaaaaaaactgcagaagatttcttgggtgaatctgtaactgaagcagtaattactgtgcctgcatacttcaacgacgcacaacgtcaagcaacgattgatgcaggtaaaatcgcaggtttagatgttaaacgtatcattaatgaaccaacagcggctgcgttagcgtttggtttaggttcaagcaaagagaaccaagtgatcgctgtttatgacttaggtggtggtacatttgatatttcaatcatcgaaattgataactttgatggcgaacaaactttcgaagtattggcaaccggtggtaacactcacttaggtggtgaagactttgataaccgtgtaattgattacattattgatgagttcaaaaaagaacaaaatatcgatttacgtaatgatgcaatggcattacaacgtgtgaaagaagctgcagagaaagcaaaaattgaactttcatcagctcaatctactgaagtgaaccttccgtacatcactgcagatgcgacaggtcctaaacacttagcattaaatatcactcgtgcaaaattagaagcattagtagaagatttagtggcaagctcaattgagtctttgaaagcggtattaaaagatgcagataaaggtgtaagcgaaatccacgatattattcttgtgggtggccaaactcgtatgccacttgtacaacaaaaagttgctgagttctttggtaaagaagcgcgtaaagatgtaaaccctgatgaagcggtggcaatcggtgcggcagttcaaggtggtgtattaaaaggtgatgtgaaagatgttcttttattagacgtaactccattatctttaggtatcgaaaccatgggcggtgtgatgaccactttaattgagaaaaataccactattccaactaaaaaatcgcaagtattctcaacagcagaagataaccaaagtgcggtaactattcacgttcttcaaggtgaacgtaaacgtgcggcagacaataaatctttaggtcaattcaatctagaaggtattaatcctgcaccgcgtggtatgccacaaattgaagtaacatttgatatcgatgcaaacggcgtaatcaacgtatcagcaaaagataaaaatacgggtaaagagcaacaaattcgtattcaagcatcatctggtttatctgatgaagaaattcaacaaatggtgcgtgatgcagaagcaaatgctgatgcagaccgtaaatttgaagaagttgttcaagctcgtaaccaagcagatggtattgctcacgcaacacgtaaacaaattgcagaagctggcgatgcattgagtgtcgcagacaaagagaaaattgaagctgcagtcgctgagcttgaaacagcagcaaaaggcgaagataaagcagaaattgaagcaaaaattgaagcggtaattaaagcctctgaaccattaatgcaagcagtgcaagcaaaagctcaacaagctggtggcgagcaaccacaacaatcatcagcaaaagatgatggcgtggtagatgctgaatttgaagaagtgaaagataataaataa

SEQ ID NO: 149 - DNA, 1191 bp, Haemophilus influenzae
atgatagaattactctttctattattgcctattgctgctgcctatggctggtatatggggcggcgtagtgcgaagaaagatcaagatgacataagtaataaactctcccgagattatgttacgggagtgaattttttactttctaatcaaactgataaagctgtagatttgtttttagatatgttgcaaaagcaagaaatcgaaaatgaaatcgaaagccactcccaatttgaagccgagcttacacttggtaatctgtttcgttctcgaggcgaagttgatcgtgcattgcgtattcatcaagctttagatcttagtcctaattatacttttgaacaaaaattacttgcaaaacaacagcttgctcgagattttatggtggttggtttttttgaccgagctgagaatctttatattttactagtagatgaacctgaatttgcagaaaatgctttacagcaacttttagtgatttatcaaaaaacaaaagaatggaaaaaagcagtcaatattgctgaaaaactcgctaaaataaagccacaagagaataatattgaacttgcgcaatgttattgtgaatattcacaaagtttagaacctgaaagtgcggttgaaaaacgcagtgttttacaaaaggctttgtcggtttctccgacttgtgttcgcgcttctttattgcttgcaaatttagcaatgcttgatggtcaatatcaacaagcagtagaaattttagaaaatgttttggagcaaaatccagattatacgggtgaaattttgtcacctttaaaacattgttatgaagaattaaatcagttagataattttgagttatttttaattcgtgcaggtcaaattattaataatgatgaagtagaactagctctagtcaaattaattgaagaaaaagatggtaagtctgctgcgcaagctaagctttatcaacaacttacaaaaaatccaagtactttaattttccatcgttttatgcagtatcaaattgatgatgcagaagacgggcggggaaaagaaagcttaattttattacataaaatggttggcgaaaggattaagcaaacatcgccttatcgttgtacaaattgtggttatcaaattcataagctattgtggaattgcccatcttgccgtcaatgggaaagtattaaaccggtttcaaatcaagaacataattaa

SEQ ID NO: 150 - DNA, 1449 bp, Haemophilus influenzae
atgttaaaccaagtttcaaatacattactgacaccaagtaatctttcaactcaaacattactcaatatttttgacattatgtcgcatcgcaatattgattatgccgatctgtattttcaacttagccaagatgaaagttgggtattagaagacggcattataaaagaaggcggttttcatattgatcgtggcgttggtgtgcgggctgtttctggtgagaaaacggggtttgcttatgcggatcaaattaatcttgcttctttgcagcaatgtgcggaggcggtaaagggaattgcgcaagtcaaacaggggaatttgatttcgctatccgcttttaatgttgtaaatcctattgctcgttatgcggcgattaatcctttggaaagtttgactaaagagaaaaaaattgagctattacatttggttgatcgtacagcacgcgcagaagatcatcgtgtaaccaaggtttcagcaagcctcagttctgtttatgaagaagtattaattatggcgacagatggcacattagccgcagatattcgtcctttagttcgcttatctatttctgtgttagtagaggaaaatggaaaacgtgaacgaggaagttgtggttctggtgggcgtttcggtttagattggttctttgaagttgttgatggcgatattagagcagtactttttgctaaagaagcggttcgtcaagccttagtaaaccttagtgcagttgcagcacccgcaggattgatgcctgttgtgttaggtgcgggttggccgggcgtattgctacacgaagcggtaggtcacggtttagaaggcgattttaaccgtaaagaaagttcactttttacaggcaagattggtgagcaagtgacttcaccgttatgtacgattgtggatgatggcacgattgaaaatcgtcgaggttcactaactattgatgatgaaggtgtgccaagccagtgcaatgtactcatcaaagacgggattttgcaaggttacatgcaagataaaatgaatgcccgtttgatgggcgttgctccaacgggaaatggacgacgtgagtcttatgcccatttaccaatgcctagaatgaccaacacctatatgcttgctggacaaagtcagtttgatgatttgattgcttctgtaaaacaggggatttatgcaccgcactttggtggagggcaagtggatattacctctggtaaatttgtattttctacttcagaagcctatttaattgaaaaaggaaaaatcacgaaaccagttaagggcgcaactttaattggcagtggcattgaagtgatgcaaaagatttctatggttgcagataaatcagaacttgatttaggtatcggggtttgtggtaaagaggggcaaagtgtacctgttggcgtaggacagccagcactaaaaattgatgaaattactgttggtggaacaaattaa

SEQ ID NO: 151 - DNA, 1728 bp, Haemophilus influenzae
atgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggtgaatatcaattgatgcgtttatatgcaatgggtgcagatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaa

SEQ ID NO: 152 - DNA, 2853 bp, Haemophilus influenzae
atggagcgaaaatattgcttcaaatatcataataaagaggtaattatgcagcagaacaaggcatttgatgattggttagccagcacagcattaggcggtgcaaatcaatcctatatagaagaactttatgaaagctatttgagtgatccacagtcggtggaggaaagctggcgaaaaacctttgattctttgccaaaaaccaccgcacttgaacagccccatactccagtgcgagattattttcgtcgtttagcgcgagaaaatcataatgaagcggtgacagtgatagatcctgctgctggtgcaaaattagtgaaagttctacaatttatcaatgcctatcgttttcgtggccatttagaggctaatcttgatcctctcaattattatcgttggaaagtatcttctgtccctgaattagattatcgccatcacggttttactgaacaagatctcaacgaaactttcaatataaatcattacgtttataaacgcgataccattaaacttggcgaattagctcaaatgttgaaagaaacatattgtggctcaattggcttggagtttatgcacgtgcaggatatggagcagaaaatgtggctccagagcaagatggaaagcctgttagataaaccgctttttacatctgaagaacgtgtcaattttcttcgtgaactgacagctgcagacggtttagaacgttatcttggtgcgaaattccctggggcgaaacgcttttctttagaaggaagtgatgcgtttattccattgatgaaagaaattattcgccattctagtcgtcaaggggtaaatgatgtggtaatgggaatggcacaccgtgggcgtttgaatatgctcgtgaatgtattaggtaaaaagcctgaaaatttattcgatgaatttgcaggtaaacattccagcgaacgtacgggggatgtgaaatatcatcaaggtttttcttctgattttgccgtagatgataagagagtccacttaacgttggcatttaatccatctcatttggaaatcgtaagccctgttgtgattggttctgttcgatctcgacaaactcgtatgaatgatacagaacatagcaaagtgcttgctattactgttcacggagattcagctgtggcaggacagggggttgttcaagaaacattgaatatgtcaaatgcccgtggttacagtgtgggcggtactattcgcatcgtgattaataaccaaattggttttacgacatctaatccgaatgacacgcgctctacagaatattgcaccgatattgcgaaaatgattcaagcaccgattattcatgttaatggcgatgatcctgaagcggtggcatttactgcgcgtatggcggtggaatatcgtaatttattcaaacgagatatttttattgatttaatttcttatcgtcgccatggccataacgaggcagatgaaccattagccactcaaccaatgatgtatagcatcatcaaaaaacatcctacaccgcgtaaagtttatgcagatcgcttagtttcagaaggcgtgatgactgaagaacaagttaccgagatggcgaatgattatcgcgatgcgctagataatggcgatcgcgtggtatctgaatggcgagaaatggatacggcaaaaatggattggttgcaatatctcaattatgattggactgcaccgtatgaaagcaaattttcacaggaacgttttttaacgcttgctaaacgtgtatgtgaatatccagaaagtttacgtgcgcaccctcgtgtagaaaaaatctataatgatcgtaaagcaatgtatcaaggcgaaaaattgctcgactggggtatggctgaaaccatggcttatgcaaccttacttgatgaaggtgttaatgttcgtttatcaggcgaagatgcgggacgaggtacttttttccatcgtcatgccgttgtgcataatcaaaatgatggtacggggtatgtaccattaacacatttacacgccaatcaaggtcgttttgaagtatgggattcggtactttctgaagaatctgttcttgcttttgaatatggctacgcaacaacagatccaaaaactttaaccatttgggaagcgcaatttggcgattttgctaatggtgcgcaaattgttatcgaccaatttattagctctggcgaacaaaaatggggcagaatgtgtggtttagttatgttattgcctcatggctatgagggacaaggccctgaacattcttccgcacgtcttgaacgttatttgcaactttgcgcagaacaaaatatgcaagtttgcgtgccatcaacacctgcacaggtgtaccatatgttgcgccgccagtctttacgtaaaatgcgccgtccattgattgccatttccccaaaatctttactacgtcatccattggcagtgtccagtttagacgagttgattaatggaactttccaaacggtaatcggagaaattgatgagcttgatcctaaagatgtaaaacgtgtggtaatgtgttcaggtaaagtttattacgatgtacttgaacaacgtcgtgcaaataatcagaaagatgtagcgattattcgtattgagcagctttatccattcccgcatgaggatgtgaagaaagcgcttgagccttatgcgcatgtcacggattatgtatggtgccaagaagaaccacttaaccaaggggcttggtattgcagcaaacataattttgaatcagcaattccagaatccgttaaactcaaatatgcagggcgtccagcttctgcttcgcctgctgtgggttatatgtcgcttcacactaaacagcaaaaacagttagtggaagatgcgttgagtttttaa

SEQ ID NO: 153 - DNA, 4479 bp, Haemophilus influenzae
atgaacaagatatatcgtctcaaattcagcaaacgcctgaatgctttggttgctgtgtctgaattgacacggggttgtgaccattccacagaaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 154 - DNA, 624 bp, Haemophilus influenzae
atgggtacagtaaaaatcacatcgcgttatggcatattgttaggctttattgccctactttgcacaataatttctacaggaattttcttcctaacaaaagataaaattgatgcggtaatcgcagcacaacagcgagaattacttctacaagttatcccacaagattatttcaacaataatttgctagaaagtgcggttattcctcaagataaaaattttgtgggtatccaaaaaatttattttgcgaaaaaagatggaaatatttctgcctatgcctatgaaaccaccgcgcctgatggctattctggcgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgctcagcattaatcatgctaaataatcaagccttgttacaacagctttcaacacaagtgaaataa

SEQ ID NO: 155 - DNA, 1980 bp, Haemophilus influenzae
atgtttcaagataatcctctactcgcacaacttaaacaacaaatccacgacagcaaagaacaggttgagggcgtggtaaaaagcacagataaagcctacggttttttagagtgcgataaaaaaacctatttcatcgcaccgccatcaatgaaaaaagtgatgcacggcgacaaaatcaaagccactattgaaaaacaaggcgacaaagaacaagccgagccagaagccttaattgagccaatgctcacacgttttatcgcaaaagtgcggttcaataaagacaagaaattacaagtgctggtggatcacccaagcattaatcaacccattggtgcacaacaggcgaaatcggtaaaagaagaattgcaagagggcgactgggtcgtcgcaaatttaaaaacccatccattacgtgacgatcgctttttctacgccacaattaatcagtttatttgccgagctgacgatgaattagccccttggtgggtcacattggcacgccacgaacaatcgcgctatcccgtgcaaggcgcagaacattatgaaatgttagatcaaaaaacacgcgaaaatctgaccgcacttcattttgtaaccattgattccgaaagcacaatggatatggacgatgccttatatatcgaacccatagcacaaaacagcacacaaacaggctggaaattagtggtcgccattgctgacccaaccgcttacatcgccttagattctcaaattgaacaagaagccaaacagcgttgcttcacaaattatttaccgggctttaacattccaatgttaccccgtgaattatccgatgaattatgttccttaatcgccaatgaaacccgccccgcacttgtctgttatatcgaaaccgatcttgcaggcaacatcacagccaaaccgcattttgtttccgcttatgtacaatctaaagccaaactggcttataacaaagtgtcggattatttagaacaggcagacaatgcatggcagccagaaacgccagaaacagcacaacaaattcactggctacatcaatttaccaaagcccgcattcaatggcacaaaacccattccttactctttaaagaaaaacccgattatgcctttgtgctggcagaaaacggcaaagtgcaagaaatcaaagcagaatatcgccgcattgccaatcaaattgtggaagaagcaatgattattgccaacatctgcgccgcacaatttttacacgaacaggcaaaaacaggcattttcaacacccacagcggttttgataaaaaattcttagagaacgcacaccatttcttaatggcaaatttagccaatgaacaaaatcaaactgaactggcagaacgttattcagtagaaaacttagcaaccttaaacggctattgccaaatgcgccacgatattgaacccatcgaaagcgattatttagaactgcgtttacgccgttatttaactttcgccgaatttaaatcagaattagcaccgcactttggtcttggtttagaaggctatgccacttggacatcgcccatccgcaaatattcagatatggttaatcatcgcttaatcaaagccgtgctggcaaaacagccttatgaaaaaacacaaaatgacgtgttggcacgtttgcaagaggctcgccgccaaaatcgcctcgtagaacgtgatattgcagattggctatattgccgttatcttgcaccgaaagtggctgaaaatgtggaatttaatgcagaagtgcaagatgtaatgcgtggtggattacgtgtgcaattattagaaaatggcgcctcaatgtttatacctgcgtccactttacataataataaagaagaaatgcaggtgaattcagatgagattgccctttatattaaaggcgaacgcacttacaaaataggcgacattgtgaaagtgaaactcacagaagtgaaagaagcaactcgcagtattgtgggcgaaatacttcaataa

SEQ ID NO: 156 - DNA, 930 bp, Haemophilus influenzae
atgaaaccaacctttctagaatttagacatcttaaaactttattggctttaaaagagacaggcagcgtttctctagctgcaaagcacgtatatctaacccaatcagccctttctcaccaaattaaattaatagaagaacaatttggcttgcctttatttgagcgtaaaagtaatccacttcgttttacttcagcgggagagcgtttaattcgtcttgcgaatgaagtaatgccgaaagtgattgatgctgaacgtgatcttgcaagggtaaaacacggcgatgcaggacagttacgtatagcggtggaatgccatacttgttttgattggttaatgccagcgatggatgaattccgtcagcattgggggctagtagaactggatattgtatctggctttcatactgatcccgttggtttattactttcccatcgagcagattgggcgatagtatcagaaatagagcataatgatgatgtcatttttaaaccgctcttttcttatgaaatggttgggatttgctcaaaaaatcattctttagcagaaaaagatatttgggaagcggaagattttattgatgaaacttgggtaacttaccccgtacctgacgatatgttagatctatggcgtaaagtgcttaaatcaaaaggcattaatcctactcgccgtacaacagaacttactattgcaatgattcaacttgttgcgagtcgtcgtggtattgcgactatcccttattgggctgcgctgccttatttggaaaagggttatgtcgtggcaagaaaagtcacaaaagaaggtttatatagcaatctatatgcggcgattcgcaaagaagatgaatccctttcttatttagaagatttttatcaaacagtcaaatctcaaagtttctcaactttacccggactttctgttttaaatttatag

SEQ ID NO: 157 - protein, 1028 aa, Haemophilus influenzae
  MISC_FEATURE (204)..(204): Xaa is selenocysteine
MQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTXHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDRDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWKNFGESNDVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 158 - protein, 651 aa, Haemophilus influenzae
MNLKKFFNTPTHEPFRDKKAERNLFARRTLVAFLGILLLTGVLFTNIYQLQIVNFDTYRTRSNGNRIKLLPLPPTRGLIYDRYGKLLAENLTFFGLYIVPEKTENLDRTLDELRYIVGLTDNDIEHFKKERLRGTRYTPILLKPNLTEEQISRFAVNGYQYPSLEVRPYFKRHYLYGETMAHILGYVGKMNDKDVERLKREDKFANYAGTNDIGKLGIERYYEDILQGTTGFEEVEINNRGKVIRTLRSRPAVAGKSIHLTIDLALQRYITELLSGLKGAVVVLDPKDSSVLAMVSTPSYDNNLFVDGISSEDYKRLLNDPARPLYSRATQGAYPPASTVKPFIAVAAQTENVITPNTTIFDPGYWVLPNSTKRFRDWKKTGHGDTDLNKAITESSDTYFYQVAYNMGIDRLSNWMKDFGFGMPTGIEIQEETAANMPTREWKQKRYKRPWVQGDTISVGIGQGYWTATPLQVAKATTILVNNGKVNTPHLMKAIEGAVLEPYEDPLIYPDISTPKVTAWEAAKRGMYNVVNAANGTGRKAFADANYRVAGKSGTAQVFSLKENEKYNAVGLKKELHDHAWFTAYAPYENPRLVVTVILENAGGGSSNAAPLARKVMDYYLNQRLPQVEKYNVPIQQKKDLSQESEQINGR

SEQ ID NO: 159 - protein, 432 aa, Haemophilus influenzae
MKTKILFFLFFSTFSFSIFAAPITIAIDPGHGGKDPGAISRNLGIYEKNVTLSIAKELKALLDKDPHFRGVLTRKSDYYISVPERSEIARKFKANYLISIHADSSESPDRRGASVWVLSNRRANDEMGQWLEDDEKRSELLGGAGKVLSHNNDKYLDQTVLDLQFGHSQRTGYVLGEHILHHFAKITTLSRSTPQHASLGVLRSPDIPSVLVETGFLSNSEEEKKLNSQTYRRRIAYMIYEGLVAFRSGKTNTLVKDNLVQNIKQNDIKKSGKNNRTSEQNINEDNIKDSGIRHIVKKGESLGSLSNKYHVKVSDIIKLNQLKRKTLWLNESIKIPDNVEIKNKSLTIKENDFHKKQNSSVNNTNKDLKKEKNTQTNNQKNIIPLYHKVTKNQTLYAISREYNIPVNILLSLNPHLKNGKVITGQKIKLREK

SEQ ID NO: 160 - protein, 558 aa, Haemophilus influenzae
MLTQLTINNFAIVRQLDIELAKGMSVITGETGAGKSIAIDALGLCFGQRVETSMVREGQERAEICATFQLESQNPAYHWLSEQELQDPDNPTECILRRIINADGRSKAFINSTPVSASQLKEIAQYLVHINGQHASQLLLKNDYQLQLVDNFAAHPELLVKMREDYQTWKNLQNQVKTFQQKVAENEARKQLLQYQVDELDEFNLRPNEYLELEDEQRRLSSSEQLTQLSQSALQILSENDTVNIDSLLYRATQYIDELAELDPQYAEVQNMLNDALIQVQEATSEVQNLSSNIEQDPQLLQEIEQRISQALQLARKHQVKPEDLVEQHKKLKAELTALLDFSESEEMLIEQEKRAFEQMQATATALTASRQQSATRLAQNVTQSIKQLAMENAEFYVELNTDLDKVSANGADNVIFTLRSNLGQQPQPLAKIASGGELSRISLAIQVLTSDQSAIPTLIFDEVDVGISGKTASVVGKLLRQLSERCQVLCVTHLPQVACHGHHQFNVEKFTVDNKTETKMTALSQAERVPALARLLGGSEITELALANAQEMLDLVH

SEQ ID NO: 161 - protein, 707 aa, Haemophilus influenzae
MSNFGVIKRDGSRAEFEIQRIINAIKKAASAVNISDEFYCHQIGQEVGNEIFTRHQGEIDINQIQKVVEDKLMASRYPEIARAYIEYRHDRDLAREKRSQLTKEIEGLIEQSNVELLNENANKDAKVIPTQRDLLAGIVAKHYAKHHILPRDVVEAHEKGEIHYHDLDYAPFFPMFNCMLVDLEGMLSRGFKMGNAEIEPPKSIGTATAVTAQIIAQVASHIYGGTTINRIDEVLSPYVQISYEKHLKHAQEWNVPDVEGYAKALIEKECFDAFQSLEYEVNTLHTSNGQTPFVTFGFGLGTSWQSRLIQQAILKNRIRGLGKNHKTPVFPKLVFTIKKGLNQNKGDPNYDIKQLALECASKRMYPDILNYDQVVKVTGSFKAPMGCRSFLGAYEENSHEIHDGRNNLGVVSLNLPRIALESKNEEDFYRTLDERLAIAKKALMTRVARLENTKARVAPILYMEGACGVRLKADENVAQIFKNGRASISLGYIGIHETINALYKKGHIFDDEQLREKGIAIVRHLSEAVKRWQKETGYAFSLYSTPSENLCDRFCRLDTKKFGVIEGITDKGYYTNSYHLDVEKKVNPYDKLDFEMSYPPLASGGFICYGEYPNIQHNLKALEDVWDYSYDRVPYYGTNTPIDECYECGFTGEFECTSRGFVCPKCGNHDSTKVSVTRRVCGYLGSPDARPFNAGKQEEVKRRVKHL

SEQ ID NO: 162 - protein, 228 aa, Haemophilus influenzae
MAEQQVKKKKKGLFYYINAVLAALLGSLILSIILEWLGIAFLWPEEGHLHSQKMMLTELGWLSDSLTRGLFYHSPKELAEGLILSLHEWLFVKTGVKDWLANPREHSGVGLWVYHYGRAYIESVIYVFITFVIRLVVIVFTSPLFLLAAFAGFTEGLMMRDRRKFGAGRESSFLYHHARRLIGPIMLSAWVLYLSIPISIYPNIILVPAAFLFGLSICVTAASFKKYL

SEQ ID NO: 163 - protein, 116 aa, Haemophilus influenzae
MESVSSKEFSVTKNIFSLSLAIGLLFGAISAQATEQEHLAQAIKQLDAAKLSLQRAAASAKVSAKSREYFDYASAHQDIATVQAGIKQYINPSRAIPRNPKAIRNLKEDYLNLRSQ

SEQ ID NO: 164 - protein, 133 aa, Haemophilus influenzae
MKLIKSFFQNVSSRFLAVVTLLWLSVENAFATGGGNGINASKIPDFKIPGVDSNTKDPMEIIYLVAKSLATLCAILFAAWSIMTVVKALIKTYNAATDENDKKGWGPFIIALILGFILIFFSLWLVKLAIGLF

SEQ ID NO: 165 - protein, 214 aa, Haemophilus influenzae
MSNLKGIVHQKNREIMTGRIAIGALLVICLVLCAIIFTAPSRLMIYNPPDLRAGSQRPWWEVPKSTVYAFAYQTFQQLNRWMENGEEEYKLNIERNKAFITPSCQEFLKKDYYDRLSNGELRERARGVYEIVGRGFKDSSVIVHSPDSWTVNLDLSVDEYFKDEPVKRVLTRFPVNIVRMETDLQNNPWGLGFNCYSSIPLRLEAKEFREGDNQ

SEQ ID NO: 166 - protein, 289 aa, Haemophilus influenzae
MKKLTLLLSAAFIFSPMTASADVLMKWARKPLPIDLQIEKERILFVDKNVKVGYPPELDSKLRIQSTGGAVYLKATADFPKTRLQLMDVATGEIILLDVQAKHSVANASEPIRFVYENKVEKQTTAYGQDANAYNEPMPNARPALPAPAALTRYAAQMFYAPLRSVEPLEGVRQVSHRLPTPLKTLLPALPVRATPLLSWQLDEYVVTAVRLQNQGQSRIDLDPRELQGRFYAATFQHNWLGGHDTPEDTTTLYLVTEGSPNHSVIPQSNSYKPKKLKKVTTTVTTQTK

SEQ ID NO: 167 - protein, 466 aa, Haemophilus influenzae
MQMKANKAFYVIGGITALVVTLMAGFLFSGSSSTNTAETKKEDTLDISFKDLSPEELRAMGIEGDTSKDTVRTLIGKVKEHNKRFDEVILQNERLVKENEQLKNQANNTDYQIQQAVQAETGALINEINALKDQVVQAGNQVVGNGNAQANPNAPLPINGATTGPQVETRGGINWVNPSDMPTTDRQGNALQGIGVNGAGIGFPKTFDNNVNDIRKSNDGLQSSTGNNAIFNTATPFFTIAANSTLTNSVAMTALVGRVPIDNKVTEPYPFKLLIGRDNLIANGIELPDIEGAIVSGTASGDWTLSCVRGDVKSLTFVFSDGRIVSTDNSDDKIGWLSDPHGVPCIPGERRTNAPEYLTTNFFLTGASAAAQGLSSSQSTTVVDGGAVIGAVTGNNGKYILGQALGGGLRETADWFRQRYGQMFDAVYVPPGKEVAVHIEKQIDIDYDRMSRKVKYGQASRQSNLD

SEQ ID NO: 168 - protein, 956 aa, Haemophilus influenzae
MALFQDVLEAFFPAKKGDKPQPKKEPILTSIAPEEAQQDDTNNVEETIEITPVMRNRKMTREQHVKMLYGRDPSFISNLPYAEYLEEEGVMLFDDAKSAGAVFDIKPIGTEGRSSDYLNRVRTLVKDALQDSFDELDTNPYVVQFYCQDDKDLSGYVENLRQYIKTTSPEASGSEFTEQWLGEMERHLKAVGKPGGLFVDDRVTNTAWAGKVRKTRMVIYRYAGNNETDTIEKLNTACDRVQSAFITAGLTMERQNETQIHRWLLEWFNPNPSRYFNGLDDKACYDLLSLSKDESALPLQDQDFSENLFFTPPESKNGYWYFNEQPHEVIVVDNIRKQPDVGHMTGEVTRGRNINALFDLLPESTIMAITVVIHPQDKLQAHLDKLSSRAVGNNYESIYLKQDALTVTEYLKDGHKLYQAGMVFYVRGKDDQELRIRSRELRTVLLSNNLVPVKEGNEVAPLNSYLRWLPMNFNPQLDAKSRFYTKYYWVQHIANMLPVFGRETGTGHPGITYFNRGGSPLDFDPLNPKDRTKNAHKLILGPTGSGKSATLTAQMAQLMAVHRPRLFIVEAGNSFGLFSDYAERYGLTVNRVSLEPSSNIALPLFSEAHRLLEMDIDLEVQDDDDNEDEGEEQRDLLAEMELTARLMITGGEAKEDEKMSRADRSAIRQAILLAAEKTSQETPPRQVLTGDVKAALEELSRRQDIRPERASRLADMAEAMDIFCTGVNGRFFNREGEIWPEADITLVDLAMFARDGYEAELAISYISLINHINSLGEKYQHSFRPIVNITDESHIITVNPLLAKFLVKGSKMWRKLGIWLWLATQNMADFPDESDKLLSMVEWWELLNLSNDEVEQVNRFRRLSEAQKMMLLSAKKADKKYTEGVVLATNMEALFRVVPPSLYLALGMTEKHEKAQRKQLMMEHNCTELDAALMVAKDLDKKRGIAVNDELNSIAA

SEQ ID NO: 169 - protein, 666 aa, Haemophilus influenzae
MKLNHALKASYIAISCAILSSTMPVSASNSNPFGFNKADSILSDMVFYQIGGGVGYMAPPSRGTIPAAEFGIGWKANLMCGNFDIKTSIKNQLNGLTEGFKDLYSNVIESATGAVASLPAMVIQRANPQLYDILTNGLYQGKIDFNSLKTSCEEMSKKLADATLNGRWSQSSDMESFKDITSTEPDATRAKKRLEESQGKEGKEWVGGKKRGGQGQEPIKIVEDVAKAGYNMQNKRNVLESGRISGSSCSGLLCQTWDNPKDMTDWLTNVIGEKQLTTCKTDCGTASSSRAGVGLTPEIEKENIKTVTQLQKALNMSTPSVEVLAELSSTTVPVTRGLIESLREDPDAQVLGQRLASEIAVAKTMEKMLLARRAVLTGMREPNVANNKDAQEELEKILTLIDREIGQIRMEIDLQKSLTGNSAVAILQNKELREYNTGTGNVTRDSVDKRISDLANGTNSNAAELADADNINIPRNNVTLEVPQMSNSLSYTGTGGTSGNSRGNTSYSSVPAIKGTALDQATGLLKKFEGFSDKAYWDVNAYRTGYGSDTITKADGTIVKVTKDTVVSRADAERDLARRTQEFANRARNNVSSSTWDKLPPNAQAALTSYAYNYGSLTKDVIAAAQASAQSGDMNALANAVRNRQNNNNGVNAKRRNQEADYILGK

SEQ ID NO: 170 - protein, 314 aa, Haemophilus influenzae
MLRIYAPASSANISVGFDTLGAAISPIDGSLLGDVVQIESISSGFELESAGYFVRKLPKEPQKNIVYQAYVLFSEQLKLRGANVKPLRLTLEKNMPIGSGLGSSACSIVAALVALNQFHNEPFSKMELLEMMGELEGRISGSIHYDNVAPCYLGGVQFMVQSLGNICQKLPFFDNWYWVLAYPGIEVSTAEARAILPKSYTRQNVIAHGRHLGGFVHACHTHQENLAAIMMKDVIAEPYRESLLPNFAEVKQATRDLGALATGISGSGPTIFSIAPDLQTAIKLSSYLESHYLQNNEGFVHVCKVDNEGTREIK

SEQ ID NO: 171 - protein, 1008 aa, Haemophilus influenzae
MVSGTKEKDLEIAIEKALTGTWRENMENKLGEPKAEYLPRHHGFKLAFSQDFDAQFAIDTRLFWQFLQTSQEAELARFQQLNPNDWQRKILERLDRQIKKNGVLHLLKKGLDIDSAHFDLLYPVPLASSGEKVKQRFEQNLFSCMRQVPYSASSNETVDMVLFANGLPIIALELKNHWTGQTAIDAQKQYLNRDLSQTLFHFGRCLAHFALDTEEAYMTTKLAGPATFFLPFNLGNNCGKGNPPNPNGHRTAYLWQEVFGKASLANIIQHFMRLDGSTKDPLDKRTLFFPRYHQLDVVRRLIADVSEHGVGKRYLIQHSAGSGKSNSITWLAYQLIEAYPRNEKAANGREADRPIFDSVIVVTDRRLLDKQLRDNIKDFSEVKNIVAPALSSAELRQSLEQGKKIIITTIQKFPFIVDGIADLGDKQFAVIIDEAHSSQSGSAHDNMNRAIGKTEDLDAEDVQDLILQTMQSRKMHGNASYFAFTATPKNSTLEKFGEKQADGKFKPFHLYSMKQAIEEGFILDVIANYTTYKSFYEITKSIEDNPEFDSKKAQSRLKAYVERSQQTIDTKAEIMLDHFIYQVFNRKKLKGKAKGMVVTQNIETAIRYFQALKHLLAGRGNPFKIAIAFSGSKVVDGVEYTEAEMNGFAESETKEYFDQDEYRLLVVANKYLTGFDQPKLCAMYVDKKLSGVLCVQALSRLNRSANKLSKRTEDLFVLDFFNSVEDIQQAFEPFYTSTSLSQATDVNVLHDLKDRLDETGVYEQAEVNDFTEGYFANKDAQQLSSMIDVAVQRFDDELELDLDRNEKVDFKIKAKQFLKIYGQMASIINFENIAWEKLYWFLKFLVPKLKVQDPMDEFDEILDAVDLSSYGLARTKLNYSIKLDDEETELDPQNPNPRGTHGEDKEKDPIDEIIRVFNERWFQDWSATPDEQRVKFINITERIRSHKDFEQKYQNNPDIHTRELAFQAILRDVMSERHRDELELYKLFAKDAAFRTAWTQSLQRALAG

SEQ ID NO: 172 - protein, 745 aa, Haemophilus influenzae
MNILINKRIFLLVTLVGIQLNVTAKQNSSNSNREELLPIIVNTNDDSNKLPGRSVLKQKNIEQQQADNAANLINILPGVNMAGGFRPGGQTLNINGMGDAEDVRVQLDGATKSFEKYQQGSIFIEPELLRRVTVDKGNYSPQYGNGGFAGTVKFETKAARDFLQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSGDIMRYGADIAWKRKLVYRDQKDKNYTLKYNYLPENNPWINLSTQFSYSKTTQNDTRPEKAPPVFLGTLGNQSWITYSDLTFDINNTSTFNIKSTRHELLFGLQWLKNTRNTLMYDKSKVKKEDYNYGYFQPYYMPSGRQYTQALYLQDQITWKNIIFSTGVRYDHINNIGQKNFAPQYNDISVGQNYSQKNYNGWSYYLGLKYDVNHYLSLFTNFSRTWRAPVIDEQYETQYKQSSGPVTATSLNLEKEMINQTRVGGIITLNHLFQENDVFQFRTTYFYNRGKNEIFKTRGVNCVGNAADTNHVCPKIIGNYRNLPGYVIQGAELEAYYQSTYLFGEITYSYVKGKRDTSPRNPWGKTSTWIAEIPPRKATTALGFNIPKYNFTAGWRAEFVRRQDRSPLSGDPEAKYWSLPASRGYSLHNLFLSWSPAKIKGMNIKITVDNLFNRAYNPYLGELASGTGRNIKFSLSQKF

SEQ ID NO: 173 - protein, 711 aa, Haemophilus influenzae
MKQLFATTSRGFEELLKVELTELGAQEAKVVQGGVHYQADDETLYRTLLWSRLASRILFPLIETKIYSDLDLYAAVSGFNWLGLFDERVTFFVDFNGTNQEIRHTQFGAMRVKDGIVDYFERQGKARPDVDKIQPDVRIHAYLNRENLVISLDLSGEALHLRGYREDAGQAPLRETLAAAIVLRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQGDVAALKNPRLNEVGTVICNPPYGERLGTTPALIALYSVFGQRLKKEFCGWNVSVFSSESTLLDCLRMRASRQFKAKNGPLDCVQKNYQVSERKSDEITAENELEFNRTSEVATDFANRLQKNIKKISKWAKQQGLDAYRLYDADLPEYNLAVDRYADYIVVQEYAAPKNIDENKARQRLLDAVTATLHVTGVETNKLILKVRQKQKGTNQYEKLANKGEYFYVNEYGAQLWVNLTDYLDTGLFLDHRLTRKMIGALAKGKDFLNLFAYTGSATVHAALGGAKSTTTVDMSNTYLNWAEQNLILNDIEGKQHKLIQADCLQWLEKCDRQFDLIFVDPPTFSNSKRMEDSWDVQRDHVKLMRNLKRVLSNNGTIVFSNNKRGFKMNLVALEELGLSAVEISHKTLPLDFERNKQIHNCWMIQHI

SEQ ID NO: 174 - protein, 256 aa, Haemophilus influenzae
MARIDNYEQRFGGIGRLYTPDGLARLRQAHICVIGIGGVGSWVVEALARSGICELTLIDMDDICVTNINRQLPAMSGTIGKLKTEVMSERVKLINPECTVNIIDDFISPENQSDYLNRGYDYVIDAIDNVKTKASLIAYCKRNKINVITIGGAGGQTDPTQIQIADLSKTIQDPLLAKVRSVLRKDYNFSQNPKRKFSIDAVFSTQPLIFPQMTEGCSTSATMNCANGFGAATMITATFGFFAVSRVIDKLLKKKS

SEQ ID NO: 175 - protein, 333 aa, Haemophilus influenzae
MKKLLKISAVSAALLSAPMMANADVLASVKPLGFIVSSIADGVTGTQVLVPAGASPHDYNLKLSDIQKVKSADLVVWIGEDIDSFLDKPISQIERKKVITIADLADVKPLLSKAHHEHFHEDGDHDHKHKHKHDHKHDHDHDHKHEHKHDHEHHDHDHHEGLTTNWHVWYSPAISKIVAQKVADKLTAQFPDKKALIAQNLSDFNRTLAEQSEKITAQLANVKDKGFYVFHDAYGYFNDAYGLKQTGYFTINPLVAPGAKTLAHIKEEIDEHKVNCLFAEPQFTPKVIESLAKNTKVNVGQLDPIGDKVTLGKNSYATFLQSTADSYMECLAK

SEQ ID NO: 176 - protein, 452 aa, Haemophilus influenzae
MKHIHILGICGTFMGGVAMIAKQMGYHVTGSDTNVYPPMNTFLEEQGIEIIPNYDVAQLQPAPDMVIVGNAMKRGNPCVEYVLENNLKYTSGPQWLHDHLLRDRWVLAISGTHGKTTTTGMLTWILEQNGLKPGFLIGGIAGNFGISARLGDSPYFVIEADEYDTAFFDKRSKFVHYNPRTLIVNNISFDHADIFDDLKAIQRQFHHMIRTIPASGLVLSSASEQSAKETLALGCWSQQQFLGKDNEWFAERITNDASHFAVFHHGEKVAEVKWNVVGQHNMHNALMAIAAAHHTGVAIEDACKALGSFVNAKRRLEVKGEVNGITVYDDFAHHPEAILATLTALRDKVGGVRILAVLEPRSNTMKMGVHKDDIAPALGRADAVFMLQPEQLSWEVADIANQCVQPAYWNANLDRLVDMIVAEAQPTDHILVMSNGSFGGIHQKILDKLKLK

SEQ ID NO: 177 - protein, 365 aa, Haemophilus influenzae
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERHKYTTAAGTRAVTVAGEVYPQKISNGVQVGAKYDANNIIAGIAYGRTNYREDIVDPDLGKKQQVNGALSTLGYRFSDLGLLVSLDSGYAKTKNYKDKHEKSYFVSPGFQYELMEDTNVYGNFKYERDSVDQGKKTREQAVLFGVDHKLHKQVLTYIEGAYARTRTTEQAKGVKTEKEKSVGVGLRVYF

SEQ ID NO: 178 - protein, 293 aa, Haemophilus influenzae
MRDLKGIFSALLVSFNEDGTINEKGLRQIIRHNIDKMKVDGLYVGGSTGENFMLSTEEKKEIFRIAKDEAKDQIALIAQVGSVNLKEAVELGKYATELGYDCLSAVTPFYYKFSFPEIKHYYDTIIAETGNNMIVYSIPFLTGVNMGIEQFGELYKNPKVLGVKFTAGDFYLLERLKKAYPNHLIWAGFDEMMLPAASLGVDGAIGSTFNVNGVRARQIFELTKAGKLAEALEIQHVTNDLIEGILANGLYLTIKELLKLEGVDAGYCREPMTSKATAEQVAKAKDLKAKFLS

SEQ ID NO: 179 - protein, 410 aa, Haemophilus influenzae
MENEMSQNGSDRDPWSKPGQSNDQQPGNSSNNNGWNNNQNRGNQEQSPPDIEEIFNNLLKKLGGGNKKSGQNNGSSQGNTPFHFGKVIPLAVAIGAIIWGVSGFYTIKEAERGVVLRFGELHSIVQPGLNWKPTFVDKVLPVNVEQVKELRTQGAMLTQDENMVKVEMTVQYRVQDPAKYLFSVTNADDSLNQATDSALRYVIGHMSMNDILTTGRSVVRENTWKALNEIIKSYDMGLEVIDVNFQSARPPEEVKDAFDDAIKAQEDEQRFIREAEAYAREKEPIARGDAQRILEEATAYKDRIVLDAKGEVERLQRLLPEFKAAPDLLRERLYIQTMEKVMANTPKVMLDGNNGNNLTVLPLEQIMGKKSVTSAPSAVNSSPAFTAPERQNSYQPQPTTVAPIRQGRFN

SEQ ID NO: 180 - protein, 772 aa, Haemophilus influenzae
MTMSELNEMQKLAWAGFAGGDWQENVNVRDFIQKNYTPYEGDDSFLAGPTEATTKLWESVMEGIKIENRTHAPLDFDEHTPSTIISHAPGYINKDLEKIVGLQTDEPLKRAIMPFGGIKMVEGSCKVYGRELDPKVKKIFTEYRKTHNQGVFDVYTPDILRCRKSGVLTGLPDAYGRGRIIGDYRRVALYGVDFLMKDKYAQFSSLQKDLEDGVNLEATIRLREEIAEQHRALGQLKQMAASYGYDISNPATNAQEAIQWMYFAYLAAIKSQNGAAMSFGRTATFIDVYIERDLKAGKITETEAQELVDHLVMKLRMVRFLRTPEYDQLFSGDPMWATETIAGMGLDGRTLVTKNTFRILHTLYNMGTSPEPNLTILWSEQLPENFKRFCAKVSIDTSSVQYENDDLMRPDFNNDDYAIACCVSPMIVGKQMQFFGARANLAKTLLYAINGGIDEKLGMQVGPKTAPITDEVLDFDTVMTRMDSFMDWLAKQYVTALNVIHYMHDKYSYEAALMALHDRDVYRTMACGIAGLSVAADSLSAIKYAKVKPVRGDIKDKDGNVVATNVAIDFEIEGEYPQYGNNDNRVDDIACDLVERFMKKIQKLKTYRNAVPTQSVLTITSNVVYGKKTGNTPDGRRAGAPFGPGANPMHGRDQKGAVASLTSVAKLPFAYAKDGISYTFSIVPNALGKDAEAQRRNLAGLMDGYFHHEATVEGGQHLNVNVLNREMLLDAMENPDKYPQLTIRVSGYAVRFNSLTKEQQQDVITRTFTESM

SEQ ID NO: 181 - protein, 1112 aa, Haemophilus influenzae
MIRKLMKTPPFFTVLFASAMFTLSVSQGALGANSTNVLPTEQSLKADLANAQKMSEGEAKNTLLAELQTSIDLLQQIQAQQKINDALQTTLSHSESEIRKNNAEIQALKKQQETATSTDYNAQSQDDLQNSLAKLNDQLQDTQNALGAANAQLAGQNSISERAQAALTENVVRTQQINQQLANNDIGSALRKQYQIELQLIDLKNSYNQNLLKNNDQLSLLYQSRYDLLNLRLQVQQQNIIAIQEVINQKNLQQSQNQLEQAQQQQQKTVQNDYIQKELDRNAQLGQYLLQQTEKANSLTQDELRMRNILDSLTQTQHTIDEQISALQGTLVLSRIIQQQKQKLPTNLNIQGLSKQIADLRVHIFDITQKRNELYDLNNYINKVESEDGKQFTEAERTQVKTLLTERRKMTSDLIKSLNNQLNLAISLELTQQQITQISDQIQSKLEQQSFWVKSNNPINLDWIKMLPRALIEQFNGMLKKLGFPTNYDNLPYLLMYFLGLFIVGGAIFKFKNRIKQQLNKINREIHRLDTDSQWSTPLALLLTAFLTLSSTLWFLAVCQMIGFFFFKNPEEFWHWSFSMAGYWWFFTFWISLFRPNGIFVNHFESSKENAQRFRGVIQRIIIVIVLLLNTSVFSNVTDAGLANDVLGQINTITALIFCAAIIAPRFNRVLRSYEPETNKHHWLIRIVQIGLRLIPVGLIVLIVLGYYYTALNLIEHFIHSYIAWCVWWLVRNTIYRGITVSSRRLAHRRLAEKRRQKALENNYENISSDDVVAVGEPEEGLALNDVRSQLLRFVDLFIWTALLGIFYYVWSDLVTVVSYLREITLWQQTTTTDAGTVIESITLFNLLVALVILGITYVLVRNISGILEVLIFSRVNLSQGTPYTITTLLTYIFIAIGGAWAFATLGMSWSKLQWLFAALSVGLGFGMQEIFANFVSGIILLFERPIRVGDVVTINGVSGTVAKIRIRAITLIDFDRKEIIVPNKSFVTGQVTNWALSSTMTRLVISVGVAYGSDLTLVRQLLLQAADEQPTVLRDPKPSAYFLTFGASTLDHELRVYVEQVGDRTSTTDAINRRINELFAEHNIDIAFNQLDVFIKNNDTGEEIPFVDVKK

SEQ ID NO: 182 - protein, 362 aa, Haemophilus influenzae
MLCVNVELQERRYPILIGSGLLQDERSYPIKRGDRVMIVTNPTVAQFYLDTVIYALEKRGCVVDHVLLPDGEKYKTLESLNLIFTALLQDNHGRDTTIIALGGGVIGDVAGFVAASYQRGVRLIQMPTTLLSQVDSSVGGKTAVNHELGKNMIGAFYQPSMVIIDTLTLNTLPKREVNAGLAEVIKYGAILDYEFFEWLEQHIDELVALHPEALQHCISRCCQIKADVVARDETEKGDRALLNLGHTFGHAIETHLGYGNWLHGEAVSTGMMMAAVLSEELGDISIADVSRLEKLLARANLPTVSPDTMQPEDYLPHMMRDKKVLSGKLRLVLLKSLGQAYVANDTDHTLVLNAIRRCTQTD

SEQ ID NO: 183 - protein, 613 aa, Haemophilus influenzae
MHRFFYNDNNVLGDLMKNFKYFAQSYVDWVIRLGRLRFSLLGVMILAVLALCTQILFSLFIVHQISWVDIFRSVTFGLLTAPFVIYFFTLLVEKLEHSRLDLSSSVNRLENEVAERIAAQKKLSQALEKLEKNSRDKSTLLATISHEFRTPLNGIVGLSQILLDDELDDLQRNYLKTINISAVSLGYIFSDIIDLEKIDASRIELNRQPTDFPALLNDIYNFASFLAKEKNLIFSLELEPNLPNWLNLDRVRLSQILWNLISNAVKFTDQGNIILKIMRNQDCYHFIVKDTGMGISPEEQKHIFEMYYQVKESRQQSAGSGIGLAISKNLAQLMEGDLTVESERGKGATFHLTLHAQEISEKESVKKNIPSLNILLVEDVDLNIMVAKTILEKLGHHVDVATNGKQAITLFEKNVYDILLLDIKLPDMSGFEIAQYLRENYENGIYDFLPPMIAFTANVMQSEQEYLEMGMDGVLRKPISIKDLHHCLQQFFADESESIIEMNDDNELSEQFDLALIETLGKKQILENLSLFKQTMPNYLAQLSKDNMKETEDTAHKIKGAAASVGLNHLRQLADTLESAAKNSDVFNCGELIDEIGNLWLEDVEDLLKFCKF

SEQ ID NO: 184 - protein, 709 aa, Haemophilus influenzae
MNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVIEAVKEFAKEAGKPRWDWVAPQPNTDLINKVKAIAEARLGDAYRITEKQARYEQIDAIKADVIAQITAEDEEISESKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 185 - protein, 462 aa, Haemophilus influenzae
MVFPWQFLRHTEENHYTAIQARGSLYVGTINNQISYFINKDSERGFEYELAKAFADTLGVELEMKIFDNQEQLFDELDKHNIDLAAAHLLYHPKNAERFQIGPAYHSASWQLAYRKNENRPKNLGNVKKDIYISNNLALEETLKELQKQYPQLTWKRNQALTQEELLLQLAEGKIPYVIANSIDIAAIQQIKPELAIAFDITDEANVHWYLPNSPYRDLQTALLNFMNNAEETGLLDNLKEKYLGHISQFDYVDTRSYMNAIENTLPQFSPLFEKYKGELDWRLLAAVAYQESHWNPDATSPTGVRGIMMLTKNTAQHMKISDRTDPEQSIKAGSEYLHWLISQLPESIEKEERIWFALVAYNIGLGHLIDARRLTQNLGGNPDNWLNVKKNLPLLAEKRYYSQLKYGYARGYEAYQYVENIRRYMNSIVNYHRVQENQTTNDNANNESAVKNLEEIKENKD

SEQ ID NO: 186 - protein, 363 aa, Haemophilus influenzae
MRVSDFNFDLPDELIARYPKTDRVSCRLLQLNGENGEIFHRTFSDVLDLIDQGDLLIFNNTHVIPARMFGRKASGGKIEVLVERMLDEHRFLAHIRSSKSPKEGAELFLGEDKLGENNGIKAVMKARHSSLFEVELSDKSTALLDVLQTIGHMPLPPYIDRPDEEADKECYQTVYSKVPGAVAAPTAGLHFDKNLLEKLKAKGVNFEFVTLHVGAGTFQPVRVENIEDHVMHAEYVEVSQEVCNAIIATKKAGKRVIAVGTTSVRSIESAALSAEEFGNPDLIEPYFSDTSIFIYPGKKFRVVDCLITNFHLPESTLIMLVSAFAGYKNTMNAYKHAVQEKYRFFSYGDAMFINKNSNVRELE

SEQ ID NO: 187 - protein, 1392 aa, Haemophilus influenzae
MKKTVFRLNFLTACISLGIVSQAWAGHTYFGIDYQYYRDFAENKGKFAVGAKDIEVYNKKGELVGKSMTKAPMIDFASVARSGYAALVGDQYIVSVAHNGGYTNADFGAEGQNPDQHRFTYQIVKRNNYKPDQKHHYNGDYHMPRLHKFVTESSPFDMTGSMKGQTYADKEKYPMRVRIGSGDQYWRNEQDKGTQVAEAYGYLIAGNTHMQTGAGNGDVSLSGDVRKGNDYGPMPTAGSFGDSGSPMFIYDATEKKWLINGVLRTGNPSLGRENTFQLVRKNYFDEIFSANLKTTIFDFRTPKNQQNQHYTFHSKNDGSGTITSGAGKIYKVKLANYNLSMKGTEPVYTNGGVNNYSPALSHGENLYFIDYGKGVLTFSNNIDQGAGGLYFEGDFIVSPTHNETWKGAGISISDESTVIWKVNGVENDRLSKIGKGTLHIQAKGKNLGSISVGDGKVILEQQEDDQHKKQAFSEIGLVSGRGTVQLNDDKQFDTDKFYFGFRGGRLDLNGHSLTFKRIQNTDEGAMIVNHNTTEVANVTITGNESIVLPNGNNINKLNYSKEIAYNGWFGETDENKHNGRLNLIYKPTTEDRTLLLSGGTNLKGDITQEGGTLVFSGRPTPHAYNHLNRPNELGRPQGEVVIDDDWINRTFKAENFQIKGGSAVVSRNVSSIEGNWTISNNANATFGVVPNQQNTICTRSDWTGLTTCKTENLTDTKVINSIPTTQINGSINLTDNATANVKGLAKLNGNVTLTNHSQFTLSNNATQIGNIRLSDNSTATVDNANLNGNVHLTNSAQFYLKNSHLSHQIQGDKGTTVTLENATWTMPSDTTLQNLTLNNSTVTLNSAYSASPNNTPRRRRRSLETETTPTSAEHRFNTLTVNGKLSGQGTFQFTSSLFGYKSDKLKLSNDAEGDYILSVRNTGKEPETLEQLTLVESKDNQPLSDKLTFTLENDHVDAGALRYVLVKNNGEFRLHNPIKEQELHNDLVRAEQAEQTLEAKQVEPTAETQTSKAKVRLRRAVLPDTLPAQSLLNALEAKQAEPNAKTQKSKAKTKKARSKRALRAVFSDPPPDQSQLDVLKAALEVINAQPQVGKERQAQEKQGKQKDLISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 188 - protein, 264 aa, Haemophilus influenzae
MQQTKRSLLGLLISLIAHGIIIGFILWNWNEPSDSANSAQGDISTSISMELLQGMVLEEPAPEPEDVQKEPEPEPENVQKEPEPEKQEIVEDPTIKPEPKKIKEPEKEKPKPKEKPKNKPKKEVKPQKKPINKELPKGDENIDSSANVNDKASTTSAANSNAQVAGSGTDTSEIAAYRSAIRREIESHKRYPTRAKIMRKQGKVSVSFNVGADGSLSGAKVTKSSGDESLDKAALDAINVSRSVGTRPAGFPSSLSVQISFTLQ

SEQ ID NO: 189 - protein, 209 aa, Haemophilus influenzae
MKKIILNLVTAIILAGCSSNPETLKATNDSFQKSETSIPHFSPLATGGVQLPKADDAYSLPNIEVKKGEDIDIRPPLIPLAIIQNSITKFDGERSLIVYPKQQAKLYNLQQVKRLLKDEGISSTTDGSILTTDWAKTERIGDKSIEIKYQIEQVMTADVSVLTVSILHMRRDGIIFTPNVSDKQYYTSERLNRIVLTLTTAYNKQLQDL

SEQ ID NO: 190 - protein, 709 aa, Haemophilus influenzae
MRFSKLSLAITTTLVTANALAQSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSTVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPETAKNKEITANLHFDSLFKQGDKFKIEATYFRNDVKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 191 - protein, 565 aa, Haemophilus influenzae
MKMRPRYSVIASAVSLGFVLSKSVMALGQPDTGSLNRELEQRRIQPEAKPSGELFNQAAKSPYTAQYKQELKFPLTQVQILDRNNQEVVTDELAHILKNYVGKEVSLSDLSNLANEISEFYRNNNYLVAKAILPPQEIEQGTVKILLLKGNVGEIRLQNHSALSNKFVSRLSNTTVNTSEFILKDELEKFALTINDVPGVNAGLQLSAGKKVGEANLLIKINDAKRFSSYVSVDNQGNKYTGRYRLAAGTKVNNLTGWGDELKLDLLSSNQANLKNARIDYSSLIDGYSTRFGVTANYLHYKLGGNFKSLQSQGHSHNLGAYLLHPTIRTPNFRLSTKVSFNHQNLTDEQQAVTVKQKRKINSLTVGIDGSWNLIKDGTTYFSLSTLFGNLANQTNEKKHNAKEDFQPQSHFTVYNYRLSHEQILPKSFAFNIGINGQFADKTLESSQKMLLGGLSGVRGHQAGAASVDEGHLIQTEFKHYLPVFSQSVLVSSLFYDYGFGKYYKNSQSLAQSVKNSVKLQSVGAGLSFSDAGSYAINVSVAKPLDNNIDNADKHQFWLSMIKTF

SEQ ID NO: 192 - protein, 921 aa, Haemophilus influenzae
MYKLNVISLIILTTYTGATYASTQGLPQEGLPQEDTVVFGNVTIDKTTADKMTITQSSPTTQINWKSFDIGQNKEVEFKQPSPNAVAYNRVTGGNASQIQGKLTANGKVYLANPNGVIITKGAEINVAGLLATTKDLEQISENGNGNGNSYQFTRKTKDGQELKEGKVLNEGKIKAKDFVVLNGDEVINKEEINVTNGKVYLSSGDNFTFTLLPDSGISVALEDNAVRGIVKNEGIIKAEDITLNAKGRKEALDSLVMNNGVLEATKVSNKNGKVVLSADEIKLDDKSNIKGDMVSFVADVTSNKELKDNIKITSQTGSKVTSPKIDFKGKSVNINGNFGRDDSKAHYNDEHKTLKTEVNIDVPDDENIRIANIEDEDKDSTGSFIQTDALSSLLANNGKVTLKGNNVNISGRIHIDSFRGSDSLLKLTNKGHIKINNADIHSKGRLFFITSLQNEEDFKSNITITDSKINLGNGAMGLGRSVNESDYDNKYQKTEGSQRKKFNVKMSNVEFNQVDDVILAGGFEKVNLDKIVATGQTNFYIDGGVSRNRTNGEPWKYEYGVLDLDKRTQLSELDQGRRRWGYYYDLELDMNRAYLYRFDLFAAKNTRRSTIKGTEINISNSNINLKNGFVHLLAEKIKLDNSKIDITFDKDNSQDTLAQTNRLGMNGKVSMINSHIKIVGDEKSGISPTGTYATMFLIGELIGEKSSIFVKSHQGYTFKTDGDTKIAGKNSKEDLKITAINTGGRAAEEVLINGALGSADNDANIANMAFTIGDSANTKTTIENADITALAPNGGTAYLSSKDVEIEVKPNSDFTFFELPREKNLNQTKINGASTKLSERGFARLYDKINGVRASNLSAEQLNVTDSSEKIINTNLVSSLDVEKLVSVAVCDAGKGCEEQQFGDKGNNTKVSVGELEAEQ

SEQ ID NO: 193 - protein, 567 aa, Haemophilus influenzae
MYTKGSVSTRIAKYLFIILIVAGVISSLSLAIMSSNKYDAEAINISGSLRMQSYRLLYEMQEQPESVETNLRRYHISLHSSALLEVQNQFFTPNVLKHSYQNILQRWTNMEKYARQQDVKNYSKQLTNYVADVDYFVFELQRFSEQKWILGVSVLGFAMLLILLMVSYVIWYTNREVVKPLHLMTKASMQVQMRQFNHIPLDTRKQNELGTLARVFTQMSTELGQLYSRLEEAVNEKTQKLRQTNRTLSTLYQSAQLLNTNTINDKILNQVLHYIFISDHLNFVKVEVMGAEHWDITLGKQDANNELQIETLSVDNEELGVLSWQAGLPCPDPRIMQNLAQMLARALYFHKNLRQKEQILLMEERSIIARELHDSLAQVLSFLQIQLTLLKHNLKKEDEQSKEKSLAIIANFEQALSGGYAQLRELLATFRLTIQEANLQLALKQVIDSLRSQTTMQMNVNCQLPSQSLNPQQLVHVLQIVREATTNAIKHSQGTVIEISARINAEGEYEILVEDDGVGIPNLEEPEGHYGLNIMAERCRQLNAQLHIHRREQGGTQVKITLPHTLY

SEQ ID NO: 194 - protein, 341 aa, Haemophilus influenzae
MQNLQPFHTFHIQSNAREIIEAHSIEQLQQVWANSKSENLPVLFLGQGSNVLFLDDFNGVVVLNRLMGITHEQDANFHYLHVNGGENWHKLVEWSINNGIYGLENLALIPGCAGSAPIQNIGAYGVEFKDVCDYVDVLNLNTNETFRLDTEQCEFGYRESTFKHRYQQGYVITAVGLKLKKDWQPILKYGSLVDFDPKTITAKQIFDEVCHIRQSKLPDPNETGNAGSFFKNPVVSSEHFEEIKKHHKNLPHFPQADGSVKLAAGWLIDQCNLKGFQIGGAAVHKKQALVLINKSGATGQDVVKLAHHVRQTVAEKFGVYLQPEVRFISATGEVNSEQIIT

SEQ ID NO: 195 - protein, 480 aa, Haemophilus influenzae
MKLDAPFNLDPNVKVRTRFAPSPTGYLHVGGARTALYSWLYAKHNNGEFVLRIEDTDLERSTPEATAAIIEGMEWLNLPWEHGPYYQTKRFDRYNQVIDEMIEQGLAYRCYCTKEHLEELRHTQEQNKEKPRYDRHCLHDHNHSPDEPHVVRFKNPTEGSVVFDDAVRGRIEISNSELDDLIIRRTDGSPTYNFCVVVDDWDMGITHVVRGEDHINNTPRQINILKAIGAPIPTYAHVSMINGDDGQKLSKRHGAVSVMQYRDDGYLPEALINYLVRLGWGHGDQEIFSREEMINYFELDHVSKSASAFNTEKLQWLNQHYIRELPPEYVAKHLEWHYKDQSIDTSNGPALTDIVSMLAERCKTLKEMASSSRYFFEEFETFDEAAAKKHFKGNAAEALAKVKEKLTALSSWNLHSIHEAIEQTAAELEVGMGKVGMPLRVAVTGSGQSPSMDVTLVGIGRDRVLVRIQRAIDFIHAQNA

SEQ ID NO: 196 - protein, 406 aa, Haemophilus influenzae
MTKKLFYYQGSNALNQKQKGSIIADTKQQAHFQLISRGLTHIKLQQNWQFGAKPKNSEISELLNQLATLLQSVIPLKNSLQILQQNCTQIMLNKWLERLLQSIESGLAFSQAIEQQGKYLTQQEIQLIQVGEMTGKLAVVCKKIATHRSQSLALQRKLQKIMLYPSMVLGISLLLTLALLLFIAPQFAEMYSGNNAELPTITAILLSISNFLKQNIGILLFFVLSFFLFYYFYLKRQTWFHQKKNQLISITPIFGTIQKLSRLVNFSQSLQIMLQAGVPLNQALDSFLPRTQTWQTKKTLVNDMVLDKEVRSILQWVSQGYAFSNSVSSDLFPMEAQQMLQIGEQSGKLALMLEHIADNYQEKLNHQIDLLSQMLEPLMMVIIGSLIGIIMMGMYLPIFNMGSVIQ

SEQ ID NO: 197 - protein, 464 aa, Haemophilus influenzae
MTSYALLHTQRVTAQNGEIFTISPDLWERNQQQQSLLLRYFALPLKEENNRLWLGVDSLSNLSACETIAFITGKPVEPILLESSQLKELLQQLTPHQMQVEEQVKFYQHQETHFEQEDDEPVIRLLNQIFESALQKNASDIHLETLADQFQVRFRIDGVLQPQPLISKIFANRIISRLKLLAKLDISENRLPQDGRFQFKTTFSDILDFRLSTLPTHWGEKIVLRAQQNKPVELSFAELGMTENQQQAFQRSLSQPQGLILVTGPTGSGKSISLYTALQWLNTPDKHIMTAEDPIEIELDGIIQSQINPQIGLDFSRLLRAFLRQDPDIIMLGEIRDEESARIALRAAQTGHLVLSTLHTNDAISAISRLQQLGIQQHEIENSLLLVIAQRLVRKICPKCGGNLINSCDCHQGYRGRIGVYQFLHWQQNGYQTDFENLRESGLEKVSQGITDEKEIERVLGKNS

SEQ ID NO: 198 - protein, 431 aa, Haemophilus influenzae
MNSMDKNQQSSQNELDLGLNQEPITPKKTIQPSSSILGKAKGLFAKKNHVQTNFQQRKEPTFGDSSTQENDPLIPSENLKKVQKPVLQTSSTEENISAVDEEISAENNADEPVEKAEKPILAQPEKWKILQVLPAKHRRLFMAIFVLVILLIIFFALKPSSDTVESFTQSNSNEVPVQFQSLDQSQPLETTILDNPPAQNQMAVEQANQSEFAPKAEEAANNTTAQNPLVENAPMQQNVVQSPSQMPNEMAAASVMPMQPAQAEQPKATVPVQPMKKAVEPQVAHKDTVKKEVKVAENAQAPSKATEQNVAKTAGNAPIVEAKPVQVKKEKKVQIVDAKPVSKSAASRLSAKTLTVPKGVSLMQVFRDNQLNISDVNAMSKAAGAGNVLSSFKSGDKVTVSVNNQGRVNEMRLSNGARFVRQSDGSYQYKK

SEQ ID NO: 199 - protein, 730 aa, Haemophilus influenzae
MKIVRVALAVPLPRLFDYFVPDDVSLQIGMRVLVPFGTQKRVAIVADFPTKSDVPEDKLKAILQPLDLAPLFTPIYWDWLHWAANYYQAGLGDVLFQALPVKLRNGESAVKNDRTFWRITDAGKNALEQGELKRSKKQAEALQCLSETDLEKGNNNFSSAIWSALKAKGFIEEITIQTNPLSWQQRLGNNPIVNAENRLTLNKQQALAFSQLLFHSGFNVWLLDGVTGSGKTEIYLQYIEEILKSGKQVLVLVPEIGLTPQTVQRFKARFNVEIDVLHSNLTDTQRLYVWDRARSGQSAIVIGTRSALFTQFSNLGAIILDEEHDSSYKQQDSWRYHARDLAIVLAQKLNIAVLMGSATPSLESINNVQNGKYQHLVLSKRAGNSTALRHFVIDLKNQNIQNGLSKPLLERMKAHLEKGNQVLLFLNRRGFAPVLLCHECGWIAQCPHCEKPYTYHQHQNVLRCHYCGAQKTIPRQCGDCGSTHLVTTGLGTEQLEETLKTLFPHYSVARIDRDSTARKGKLEGYLEDIQQGKSQILIGTQMLAKGHHFPNVTLVALVNVDSALFSLDFRAEERLAQLYIQVAGRAGRADKQGEVVLQTHYPDHPLLTTLLANGYQAFAKETLQLRHSMGLPPFTFQALFKAQARHSDLAENCLSQIADFFQSKQITGLQMLGPMPAPFSKKAGQYRWQLLLQHPSRMTLQKALREYQQAELEKNSLVRLILDVDPQDLS

SEQ ID NO: 200 - protein, 832 aa, Haemophilus influenzae
MGENAMNLSRRDFMKANAAMAAATAAGLTIPVKNVVAAESEIKWDKAVCRFCGTGCAVLVGTKDGRVVASQGDPDAEVNRGLNCIKGYFLPKIMYGKDRLTQPLLRMTNGKFDKNGDFAPVSWDFAFKTMAEKFKEAFKKNGQNAVGMFSSGQSTIWEGYAKNKLWKAGFRSNNVDPNARHCMASAAVAFMRTFGMDEPMGCYDDIEQADAFVLWGSNMAEMHPILWSRITDRRISNPDVRVTVLSTYEHRSFELADHGLIFTPQTDLAIMNYIINYLIQNNAINWDFVNKHTKFKRGETNIGYGLRPEHPLEKDTNRATAGKMHDSSFEELKQLVSEYTVEKVSKMSGLDKVQLETLAKLYADPTKKVVSYWTMGFNQHTRGVWVNQLIYNIHLLTGKISIPGCGPFSLTGQPSACGTAREVGSFPHRLPADLVVTNPKHRETAERIWKLPKGTVSEKVGLHTIAQDRAMNDGEMNVLWQMCNNNMQAGPNINQERLPGWRKEGNFVIVSDPYPTVSALSADLILPTAMWVEKEGAYGNAERRTQFWRQQVKAPGEAKSDLWQLMEFAKYFTTDEMWTEDLLTQMPEYRGKTLYEVLFKNGQVDKFPLSELAEGQLNDESEYFGYYVHKGLFEEYAEFGRGHGHDLAPFDMYHKAHGLRWPVVEGKETLWRYREGYDPYVKEGEGVAFYGYPDKKAIILAVPYEPPAESPDNEYDLWLSTGRVLEHWHTGTMTRRVPELHRAFPNNLVWMHPLDAQARGLRHGDKIKISSRRGEMISYLDTRGRNKPPRGLVFTTFFDAGQLANSLTLDATDPISKETDFKKCAVKVEKAA

SEQ ID NO: 201 - protein, 320 aa, Haemophilus influenzae
MSINQSINQSINQSINQSINQSINQSKSVIIAGNGTSLKSIDYSLLPKDYDVFRCNQFYFEDHYFLGKKIKKVFFNCSVIFEQYYTFMQLIKNNEYKYEYADIILASFLNLGDSTLKKIQHLEKLLPQIDLGHCYLKKLRAFNAHLQYHELYENKRITSGVYMCAVATAMGYKDLYLTGIDFYQEKGNPYAFHHQKENIIKLLPSFSQNKSQSDIHSMEYDLNALYFLQKHYGVNIYCISPESPLCNYFPLSPLNNPIAFIPEEKKNYTQDILIPPKFVYKKIGIYSKPRIYQNLIFRLFWDILRLPNDIKHALKSRKWD

SEQ ID NO: 202 - protein, 408 aa, Haemophilus influenzae
MQNNRQKKGINAFAISILLHFILFGLLILSSLYHTVEIMGGGEGEGDVIGAVIVDTGTAAQEWGRIQQQKKGQADKQKRPEPVVEEKPPEPNQEEIKHQQEVQRQEEIKHQQEVQRQEELKRQQEQQRQQEIKKQQEQARQEALEKQKQAEEARAKQAAEAAKLKADAEAKRLAAAAKQAEEEAKAKAAEIAAQKAKQEAETKAKLEAEAKAKAAAEAKAKAEAEAKAKAAAEAKAKAEAEAKAKAAAEAKAKADAEAKAKAAAEAKAAAEAKRKADQASLDDFFNGGDVGGGSASKGGNTNKGGTQGSGAALGSGDGGKVGDQYAGVIKKEIQRRFLKDPNFAGKVCRIKIQLGRDGTILGYQKISGSDDICSAALSAVARTKKVPAAPSDEIYEKYKSPIIDFDIR

SEQ ID NO: 203 - protein, 562 aa, Haemophilus influenzae
MEKIWFQNYPEGSEKFLDTSKYESILDMFDKAVREHPDRPAYINMGQVLTFRKLEERSRAFAAYLQNEFKLQRGDRVALMMPNLLQYPIALFGILRAGLIAVNVNPLYTPRELELQLQDSGAVAIVVVSNFASTLEKVVFNTNVKHVILTRMGDQLSFGKRTLVNFVVKYVKKLVPKYKLPHAVTFREVLSIGKYRQYVRPEISREDLAFLQYTGGTTGVAKGAMLTHGNIITNVFQAKWIAEPFIGDHSRTRSAILALPLYHVFALTVNCLLFLELGITAILITNPRDIEGFVKELKKYRFEAITGVNTLFNALLNNENFKEVDFSALKLSVGGGMAIQQSVATRWHELTGCNIIEGYGMTECSPLIAACPINVVKHNGTIGVPVPNTDIKIIKDDGSDAKIGEAGELWVKGDQVMRGYWQRPEATSEVLKDGWMATGDIVIMDESYSLRIVDRKKDIILVSGFNVYPNEIEDVVMLNYKVSEAVAIGIPHAVSGETIKIFVVKKDDSLTRDELRNHCRQYLTGYKVPKEIEFRDELPKTNVGKILRRVLRDEEIAKRPKH

SEQ ID NO: 204 - protein, 458 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVNSYATITSASSGVRTIKHGSASQRNVVPGAFVPNLYFVAPVNDKFALGAGMNVNFGLKSEYDDSYDAGVFGGKTDLSAINLNLSGAYRVTEGLSLGLGVNAVYANAQVERNAGIIVETIDNQVNTALSALQEPFRDLKKHLPSKDKSVVSLQDRAAWGFGWNAGVMYQFNEANRIGLAYHSKVDIDFTDRTATSLEANVIKAGKKGDLTFTLPDYLELSGFHQLTDKLAVHYSYKYTHWSRLTKLHASFEDGKKAFEKELQYSNNSRVALGASYNLYEKLTLRAGIAYDQAASRHQRSAAIPDTDRTWYSLGATYKFTPNLSVDLGYAYLKGKKVHFKEVKTIGEPRALTFNTTANYTSQAHANLYGLNLNYSF

SEQ ID NO: 205 - protein, 430 aa, Haemophilus influenzae
MDLLSDIEKQLQKATAQGFLIALSGGLDSTVLLSLFAKLCQKQPHLPPLSVRAIHIHHGLSPNADSWAKHCQNLCDQFQIPLIIERVQVDKTNGIEAGAREARYQAIKKHLQIQEMLVTAHHLNDQTETFFLALKRGSGLQGLSAMQQQSVLFGMPIFRPLLGFTRPQLEDYAQQEKLNWVTDESNEDNRYDRNFLRNEILPKLRERWAHFDLAVQRSAQHCFEQQQLINDLLSEIFTEHCQIKNQFKLLQFRQYSLAKQTALLRMWLAKNQLEMPSKRQLTQLINDVIFAKEEANPQFQLVNKVIRRYQDSLYLTKPFSDLTKCTLKLEQNMLNLPDDLGNLTVHENEHNLIFYWQDYSVTLEKTNLPISIRFGYSGKVKHHPKRPREDIKKIWQELSVPPWERNRIPLIFYGNELKSAVGFFRVFDEY

SEQ ID NO: 206 - protein, 261 aa, Haemophilus influenzae
MFEILFPALLTGIVLSLITAPLGVFVVWRKMAYFGDTLSHSALLGVALGIFLQVNPYIAIVVLTLILAIAMVWLESNTQFSIDTLLGIIAHSCLSLGVVTVGLLRNVRVDLMNYLFGDLLAINYTDLIYIGIGVIIVLSTLIYFWQSLLSTTVSPELAQVEGINIKKMRFILMILTALTIALSMKFVGALIITSLLIIPAATARRFARTPESMVGWAIIMSMLSIIGGLILSAFYDTAAGPSVVICSAFLFVLSLFKKERL

SEQ ID NO: 207 - protein, 475 aa, Haemophilus influenzae
MPVQHVKLARDRRKKRTYIKVGVFFVAILLILTGILLTIKDKSEENPIFSTSDSGEYHELNTSPNKNSTALQPDEDATSYDDELQAKDDEVDEVKLSSDDLGTLPQHAQDALNGLLDAADQAIRITDQFSYTVTEGDTLKDVLVLSGLDDSSVQPLIKLDPELAHLKAGQQFYWILNKNDNLEYLNWLVSEKEERIYERLEDGKFKRQVIEKKSIWRKEVLKGEIQNSLNSSLREQGLDTRQISQLSNALQWQVSLRKLKKGTQFAILVSREYLGDKLTGQGNVEALRISSGGKNYYAVQAANGRYYNQQGETLGKGFARYPLQRQARVSSPFNPNRRHPVTGRVRPHKGVDFSVSQGTPVIAPADGTVEKVAYQAGGAGRYVMLRHGREYQTVYMHLSKSLVKAGQTVKKGERIALSGNTGISTGPHLHYEFRINGRAVNPLTVKLPGTSSGMTSAERKQFLVRVREAEKMLKP

SEQ ID NO: 208 - protein, 864 aa, Haemophilus influenzae
MRIAKLILNTLLTLCILGLVAGGMLYFHLKSELPSVETLRTVELQQPMQIYTADGKLIGEVGEQRRIPVKLADVPQRLIDAFLATEDNRFYDHHGLDPIGIARALFVAVSNGGASQGASTITQQLARNFFLTPEKTIIRKAREAVLAVEIENTLNKQEILELYLNKIFLGYRSYGVAAAAQTYFGKALNELTLSEMAIIAGLPKAPSTMNPLYSLKRSEERRNVVLSRMLDEKYISKEEYDAALKEPIVASYHGAKFEFRADYVTEMVRQEMVRRFGEENAYTSGYKVFTTVLSKDQAEAQKAVRNNLIDYDMRHGYRSGAPLWQKNEAAWDNDRIVGFLRKLPDSEPFIPAAVIEIAKGGADILLASGEKMTLSTNAMRWTGRSNPVKVGEQIWIRQRANGEWQLGQIPAANSALVSLNSDNGAIEAVVGGFSYEQSKFNRATQSLVQVGSSIKPFIYAAALEKGLTLSSVLQDSPISIQKPGQKMWQPKNSPDRYDGPMRLRVGLGQSKNMIAIRAIQTAGIDFTAEFLQRFGFKRDQYFASEALALGAASFTPLEMARAYAVFDNGGFLIEPYIIEKIQDNTGKDLFIANPKIACIECNDIPVIYGETKDKINGFANIPLGESALKPTDDSTNGEELDQQPETVPELPELQSNFTALKEDAIDLMAAAKNASSKIEYAPRVISGELAFLIRSALNTAIYGEQGLDWKGTSWRIAQSIKRSDIGGKTGTTNSSKVAWYAGFGANLVTTTYVGFDDNKRVLGRGEAGAKTAMPAWITYMKMALSDKPERKLPLPPKIVEKNIDTLTGLLSPNGGRKEYFIVGTEPTRTYLSEMQERGYYVPTELQQRLNNEGNTPATQPQELF

SEQ ID NO: 209 - protein, 556 aa, Haemophilus influenzae
MKLFLTQSANVGDAKAYLLHEVFRAAAQKANVSIVETPAEADLVLVFGSVLPNNPALVGKKVFIIGEAIAMISPEVTLANALANGADYVAPKSAVSFTGVSGVKNIVAVTACPTGVAHTFMSAEAIEAYAKKQGWNVKVETRGQVGAGNEITAEEVAAADLVFVAADIDVPLDKFKGKPIYRTSTGLALKKTEQEFDKAFKEAKIFDGGNNAGTKEESREKKGVYKHLMTGVSHMLPLVVAGGLLIAISFMFSFNVIENTGVFQDLPNMLINIGSGVAFKLMIAVFAGYVAFSIADRPGLAVGLIAGMLASEAGAGILGGIIAGFLAGYVVKGLNVIIRLPASLTSLKPILILPLLGSMIVGLTMIYLINPPVAEIMKELSNWLTSMGEVNAIVLGVIIGAMMCIDMGGPVNKAAYTFSVGLIASQVYTPMAAAMAAGMVPPIGMTVATWIARNKFTVSQRDAGKASFVLGLCFISEGALPFVAADPIRVIISSVIGGAVAGAISMGLNITLQAPHGGLFVIPFVSEPLKYLGAIAIGALSTGVVYAIIKSKNNAE

SEQ ID NO: 210 - protein, 313 aa, Haemophilus influenzae
MASVVTITLNAAYDLVGRLNRIQLGEVNTVETLGLFPAGKGINVAKVLKDLGVNVAVGGFLGKDNSADFEQMFNQHGLKDKFHRVNGKTRINVKITETEADVTDLNFLGYQISPQIWQQFVTDSLAYCLDYDIVAVCGSLPRGVSPELFADWLNQLHQAGVKVVLDSSNAALTAGLKAKPWLVKPNHRELEAWVGHSLNSLEEIIAAAQQLKAEGIENVIISMGAKGSLWINNEGVLKAEPAKCENVVSTVGAGDSMVAGLIYGFEKGLSKTETLAFATAVSAFAVSQSNVGVSDLSLLDPILEKVQITMIEG

SEQ ID NO: 211 - protein, 707 aa, Haemophilus influenzae
MKLEASKQASKQASKQASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 212 - protein, 313 aa, Haemophilus influenzae
MKMKKFILKSFLLATLGCVAFTSMAQAEERVVATVDGIPILESQVRANMGKKGDRQSALDKIIDDLLVQKAIQESGVKIDPREIDRVVEDTAARNGLTYGQFLDALDYQGISLNTFRQQIANQMVMGAVRNKAIQESIDVTREEVVALGQKMLDEAKSQGTAQKVTGKEYEVRHILLKLNPLLNDAQAKKQLAKIRSDIIAGKTTFADAALKYSKDYLSGANGGSLGYAFPETYAPQFAQTVMKSKQGVISAPFKTEFGWHILEVTGVRDGDLTAEAYTQKAYERLVNTQLQDATNDWVKALRKRANIQYFNK

SEQ ID NO: 213 - protein, 444 aa, Haemophilus influenzae
MSEMTPREIVSELDQHIIGQADAKRAVAIALRNRWRRMQLQEPLRHEVTPKNILMIGPTGVGKTEIARRLAKLANAPFIKVEATKFTEVGYVGKEVDSIIRDLTDSAMKLVRQQEIAKNRARAEDAAEERILDALLPPAKNQWGEVENHDSHSSTRQAFRKKLREGQLDDKEIEIDVSAGVSMGVEIMAPPGMEEMTNQLQSLFQNLGSDKTKKRKMKIKDALKTLIDDEAAKLINPEELKQKAIDAVEQNGIVFIDEIDKICKKGEYSGADVSREGVQRDLLPLVEGSTVSTKHGMVKTDHILFIASGAFQVARPSDLIPELQGRLPIRVELTALSAADFERILTEPHASLTEQYKALMATEGVNIEFTTEAVKKIAEAAFRVNEKTENIGARRLHTVMERLMDKISFSASDMNGQTVNIDAAYVADALGEVVENEDLSRFIL

SEQ ID NO: 214 - protein, 493 aa, Haemophilus influenzae
METLLKISGVDKSFPGVKALNNACLSVYAGRVMALMGENGAGKSTLMKVLTGIYSKDAGTIEYLNRSVNFNGPKASQEAGISIIHQELNLVGNLTIAENIFLGREFKTSWGAINWQKMHQEADKLLARLGVTHSSKQLCAELSIGEQQMVEIAKALSFESKVIIMDEPTDALTDTETEALFNVIRELKAENRGIVYISHRLKEIFQICDDVTVLRDGQFIGERIVAEITEDDLIEMMVGRRLDEQYPHLSQEKGECVLDVKNVSGSGIDDVSFKLHAGEIVGVSGLMGAGRTELGKLLYGALPKTAGKVRLKNQEIENLSPQDGLDNGIVYISEDRKGDGLVLGMSVKENMSLTSLDHFSQKGSIRHQAEKMTVDDFILMFNIKTPNRDQQVGLLSGGNQQKVAIARGLMTRPNVLILDEPTRGVDVGAKKEIYQLINEFKKEGLSILMISSDMPEVLGMSDRVLVMREGKISAEFSRKDATQEKLLAAAIGK

SEQ ID NO: 215 - protein, 417 aa, Haemophilus influenzae
MSVLSSILGMVVLIAIAVLLSNNRKAISIRTVVGALAIQVGFAALILYVPAGKQALGAAADMVSNVIAYGNDGINFVFGGLADPSKPSGFIFAVKVLPIIVFFSGLISVLYYLGIMQVVIKVLGGALQKALGTSKAESMSAAANIFVGQTEAPLVVRPYIKNMTQSELFAIMVGGTASIAGSVMAGYAGMGVPLTYLIAASFMAAPAGLLFAKLMFPQTEQFTDKQPEDNDSEKPTNVLEAMAGGASAGMQLALNVGAMLIAFVGLIALINGILSGVGGWFGYGDLTLQSIFGLIFKPLAYLIGVTDGAEAGIAGQMIGMKLAVNEFVGYLEFAKYLQPDSAIVLTEKTKAIITFALCGFANFSSIAILIGGLGGMAPSRRSDVARLGIKAVIAGTLANLMSATIAGLFIGLGAAAL

SEQ ID NO: 216 - protein, 264 aa, Haemophilus influenzae
MKKLTSILSLIVLVILAIWQYFTDTTKTKHQSSSPVIEQTKQTKVSEPKFEPKFEPQFETKRTDIEKSAVKNPDVFANYDVIMRNDHIGQNAKAPVDYYMLALSWSPGFCDIQREKYGDQLPYSSQYQCGNNRTFGWVVHGLWPQNANARAVSDHPRFCKGDLPALPKGLLAQYLAISPGEKLLQGEWEKHGSCAFDSAQQYFAKEQELFNALKLPNQKLSRDELFGWMKQHNPQLKNAYLRASRNELFICYDKKWQVMNCQSK

SEQ ID NO: 217 - protein, 96 aa, Haemophilus influenzae
MNIRPLHDRVIIKREEVETRSAGGIVLTGSAATKSTRAKVLAVGKGRILENGTVQPLDVKVGDTVIFNDGYGVKAEKIDGEEVLIISENDILAIVE

SEQ ID NO: 218 - protein, 149 aa, Haemophilus influenzae
MQVILLDKIAHLGQVGDQVNVKSGFARNFLIPQGKAVMATKANIEHFEARRAELEATAAANLAAAQARAAEVTALGSVTIASKAGDEGRLFGAITTRDVAEAVTAAGVKIAKSEVRLPNGPIRTLGDHDVRFQLHGEVFATLDVIVVAE

SEQ ID NO: 219 - protein, 315 aa, Haemophilus influenzae
MKKIALKFTALSLSLLLSSIASAEELSAKQSLDKMTQALDNLNYEIAFVQTTPANMDSFRYRHIKQDNKTYAQLVTLDGRQQEIIQRDNLVSYFQPNAQAFTLNSGNIVDAMPAVVRANFDKLSSDYDFVKLGKDRVAGRFADTIRIVPKDDFRYQYLVFIDEENGLLLRSDMLDREGKLLDQFRVVTLYIDDRLRGLTDYINKVSLPPLLKESKNEQSSDITWSAGWLPQGFSLIRYTQEILENEIIDSALYSDGLFTFTLFVSNVSSNDLPENTWKQGAYTIYSEVIGGKEITFIGQLPISTAKRIVQEVKFR

SEQ ID NO: 220 - protein, 431 aa, Haemophilus influenzae
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILAGTFGSMMSPGSSHSAMISEMSGLTITQVNLSHAPYNMIAGAIGAVVLTILALVFKDYGEQHRQAYLAEQKESEIKVVEGVNVLYALAPLIPLVILVIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHINLGMAAAIAGAIGRTASPIAGVTIVCAGLAMVSPVEMVKRTAPGMILAVLFLALFML

SEQ ID NO: 221 - protein, 657 aa, Haemophilus influenzae
MINRRHFIQIGATSILALSANRFAMAKGKSDVDLRIVATTDVHSFLTDFDYYKDAPTDKFGFTRAASLIRQARAEVKNSVLVDNGDLIQGNPIADYQAAQGYKEGKSNPAVDCLNAMNYEVGTLGNHEFNYGLNYLADAIKQAKFQIVNANVVKAGTEEPYFTPYVIQEKSVVDNNGKTHKLKIGYIGFVPPQIMVWDKANLQGKVETHDIVKTAQKYVPEMKKKGADIIVALAHTGPSDEPYQEGAENSAFYLADVPHIDAVIFGHSHRLFPNKEFAKSPNADIVNGTVKGVPESMAGYWANNISVVDLGLTEHKGKWIVTSGKAVLRPIYDAKNKKVLAENDPEITALLKPVHEATRKFVSQPIGKATDNMYSYLALVQDDPTIQIVNQAQKAYVEKVAPNVAAMAGLPILSAGAPFKAGGRKNDPTGYTEVNKGELTFRNAADLYLYPNTLVVVKATGEQLKEWLECSAGMFKQIDPTSDKPQSLIDWEGFRTYNFDVIDGVNYEYDLTKPARYDGECKLINPESHRVVNLTYQGKPVDPKAEFLIATNNYRAYGNKFPGTGDQHIVYASPDENRQILADYIKVTSEKEGSVNPSADKNWRFVPISGNDKLDVRFETSPSEQAAQFIKEKAQYPMKQVGTDEVGFAVYQIDLSK

SEQ ID NO: 222 - protein, 124 aa, Haemophilus influenzae
MATINQLVRKPRVKKVVKSNVPALEACPQKRGVCTRVYTTTPKKPNSALRKVCRIRLTNGFEVTSYIGGEGHNLQEHSVVLIRGGRVKDLPGVRYHTVRGALDCAGVKDRKQGRSKYGVKRPKA

SEQ ID NO: 223 - protein, 456 aa, Haemophilus influenzae
MTKKALSAVILAAGKGTRMYSDLPKVLHTIAGKPMVKHVIDIAHQLGSENIHLIYGHGGDLMRTHLANEQVNWVLQTEQLGTAHAVQQAAPFFKDNENIVVLYGDAPLITKETLEKLIEAKPENGIALLTVNLDNPTGYGRIIRENGNVVAIVEQKDANAEQLNIKEVNTGVMVSDGASFKKWLARVGNNNAQGEYYLTDLIALANQDNCQVVAVQATDVMEVEGANNRLQLAALERYFQNKQASKLLLEGVMIYDPARFDLRGTLEHGKDVEIDVNVIIEGNVKLGDCVKIGAGCVLKNVVIGNDVEIKPYSVLEDSIVGEKAAIGPFSRLRPGAELAAETHVGNFVEIKKSTVGKGSKVNHLTYVGDSEIGSNCNIGAGVITCNYDGANKFKTIIGDDVFVGSDTQLVAPVKVANGATIGAGTTITRDVGENELVITRVAQRHIQGWQRPIKKK

SEQ ID NO: 224 - protein, 638 aa, Haemophilus influenzae
MIVFSNLSLKRGQTELLENASATINPKQKVGLVGKNGCGKSSLFALLKKELTPEGGEVNYPANWRVSWVNQETPALDISAIDYVIQGDREYCRLQQELEQANECNDGNAIARIHGQLETLDAWTIQSRAASLLNGLGFSQEETTQPVKAFSGGWRIRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFKFRPPQSLPNPLVMIEQASAGYGSGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLNEQNSTSENKVSEKVGDNENSVQNRKEQKRREAELRQQTAPLRKKITQLEEKMNKFSSELANIENQLADTELYNAENKEKLTALLAQQVDVKKALDDVETEWMTAQEELEEMLQA

SEQ ID NO: 225 - protein, 992 aa, Haemophilus influenzae
MGLNMTNFRLNVLAYSVMLGLTAGVAYAAQPTNQPTNQPTNQPTNQNGNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTSRNGHELENYDYKNANSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPAGLKLTDGKITRRDGSELQFEKKDKNIDNNIYDFDKFIDTDDRVIEGKLGLRRSSGTWYDCSIFDCKDKTKMKIFETEHPYGYGTTGTWKKDFELEIKKLNDKNFARVKDANNKTYSILPSSPGYLERLWQERDLDTNTQQLNLDLTKDFKTWRVEHNLQYGSSYNTTMKRMVNRAGNDASDVQWWAEPTLGYSLLYDKPHTCKTAYGGWKANLCPRVDPKFSFLLPIKTKEKSVYLFDNVVITDYLSFDLGYRYDNIHYQPKYKHGVTPKLPDDIVKGLFIPLPSGKNNNDDPEVKKNVQQNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLIFKGEKDFKLVSGGSTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 226 - protein, 274 aa, Haemophilus influenzae
MKTTLKMTALTALSALVLAGCGAHQMKSEEQANMQLQQQAVLGLNWMQDSGEYKALAYQAYNAAKVAFDHAKVAKGKKKAVVADLDETMLDNSPYAGWQVQNNKPFDGKDWTRWVDARQSRAVPGAVEFNNYVNSHKGKVFYVTNRKDSSEKAGTIDDMKRLGFNGVEESAFYLKKDKSAKAARFAEIEKQGYEIVLYVGDNLDDFGNTVYGKLNADRRAFVDQNQGKFGKTFIMLPNANYGGWEGGLAEGYFKKDTQGQIKARLDAVQAWDGK

SEQ ID NO: 227 - protein, 405 aa, Haemophilus influenzae
MNKSFLLLPLSLVVLSACTSNSPAPISDADGNLSPSVVQSVNGSNVGGAWQPEIQKNSLPTMGNMVTPQPNFQPINQQPAMPTKPAQPAFQPSPKTVVSAPTVQTKTVTKTIADCVDGQHINIPRNPNTNAPDYSKISKGSYKGNTYKVNKGDTMFLIAYLAGIDVKELAALNNLSEPYNLSLGQVLKISNCGTKTVTTTVSVKQPAVTASTAMPAKPAVTYTPGANGTQIGSDGTIIGPIKSEAGISSSVSVATSSTQVTSSVNNANSTPINANVVAPIASNVAWQWPTSGNIIQGFSSTDGGNKGIDISGSRGQAVKAAAAGRIVYAGNALRGYGNLIIIKHNDDFLSAYAHNDKILVADQQEVKAGQDIAKMGSSGTNTVKLHFEIRYKGKSVDPVRYLPKR

SEQ ID NO: 228 - protein, 861 aa, Haemophilus influenzae
MISEENFQQHTPMMQQYLKLKAENPDILLFYRMGDFYELFYDDAKKAAALLDISLTKRGQSAGQPIPMAGMPYHAVEGYLAKLVQLGESVAICEQIGDPSTSKGPVERQIVRIVTPGTVSDEALLPERQDNLIAAVYQEKEKFGLATLDMTSGRFQLCEPADKETLRAELQRIVPVELLYCEEFNEMAAIEHCKGLRRRPIWEFELSTAITLLNRQFGTKDLRAFGVEKSPLGLSAAGCLLQYAKETQRTALPHIQSISLIQNQDCIQLDAATRRNLELTQNLSGGTENTLASVLDKCVTPMGSRLLKRWIHQPIRDVEKLKQRQQAIAEILNFDLVDELQPYLQLVGDMERILARVALRSARPRDLTRLRTALEQIPALRTIVQQKTSPFLTALFSQIADFSEQWDLLQRALIETPPLLIRDGGVIAEGYHAELDEWRMLSDGATQYLENLEKRERESTGIDTLKIGFNAVHGYYIQISQGQAHKAPIHYVRRQTLKNAERYIIPELKEYEDKVLKSKGAALALEKQLYDELFDLLLPHLGSLQLASLALSELDVLVNLAECADTLNYVMPTFCDEVSVKIENGRHPVVEQVLKDPFIANPVELNHNRHLLIITGPNMGGKSTYMRQTALITLLAYIGSFVPADSARIGPIDRIFTRIGASDDLASGRSTFMVEMTEMANILHQATEQSLVLIDEIGRGTSTYDGLSLAWACAEWLAKKIRSLTLFATHYFELTALPEQLEGIANIHLDALEHNNSIAFMHAVQDGAASKSYGLAVAALAGVPQSVIKLAKQKLTQLEKNSSYSAEQQIQALREANHNQGELLFEQETDALREAIEKLDPDDLSPKQALAYLYQLKKMVG

SEQ ID NO: 229 - protein, 470 aa, Haemophilus influenzae
MAIALIFDCGATNLRTIAINEKGQILASHHLANNTKQGIESSDYHIWDIEEIWQKLISCATQTFNQLIQQGIDLKDIVGISVTTFGVDGAPFDKNDQQLYPIISWKCPRTIPVMENLSNQLDIKSLYQRNGIGQYSFNTLFKLHWLKTHKPDVFQKMAKFVFISSMLTQRLTGQFTTDHTMAGTSMMTNLTSGNWDPSILASLGLSNNHFPPMRYAGEKVGKLRTPLAQKWGLNPVPVISCGHDTQFAVFGSGAGLNQPVLSSGTWEILMARTQHAEPRFEFVSQGLTTEFDAQSNCFNPAVQWVGSGVIEWLGKLLFSDVYGSDHYYTTMIKEGEKAFNAGKRAVNFEGIFSQKGQGNISGLSMFATRGEIYVSALQHMANKLKNGLSVLHQVSQFQAKSLICVGGGSKNVLWNQIRANTLNLPIDVVDISESTVLGAAMFTFAGVGIYENVNAAQQAMQPTRKRIYPN

SEQ ID NO: 230 - protein, 357 aa, Haemophilus influenzae
MKKYLLLALLPFLYACSNSSNQGINYDEAFAKDTQGLDILTGQFSHNIDRIWGVNELLVASRKDYVKYTDSFYTRSHVSFDEGNIVIETQQDLNRLHNAIVHTLLMGADAKGIDLFTSGDVPISSRPFLLGQVVDHQGQQIANQVIASNFATYLIQNKLQTRRLQNGHTVQFVSVPMIANHVEVRARKYLPLIRKAAQRYGIDESLILGIMQTESSFNPYAISYANAIGLMQVVPHTAGRDVFAMKGKGGQPSTRYLYDPANNIDAGVSYLWILQNQYLDGITNPTSKRFAMISAYNSGAGAVLRVFDNDKDTAIYKINQMYPEQVYRILTTVHPSSQARNYLLKVDKAQKKFRVRR

SEQ ID NO: 231 - protein, 235 aa, Haemophilus influenzae
MGQKVHPHGIRLGIVKPWSSTWFANTQDFADNLEGDFKVRKFLNKELANASVSRITIERPAKSIRVTIHTARPGIVIGKKGEDVEKLRNAVSKIAGVPAQINIAEVKKPELDAKLVADSIASQLERRVMFRRAMKRAVQSAMRLGAKGIKVEVSGRLGGAEIARSEWYREGRVPLHTLRADIDYNTAEAHTTYGVIGVKVWIFKGEILGGMAAVAQSEQQPADKPKKAPRGKGRK

SEQ ID NO: 232 - protein, 144 aa, Haemophilus influenzae
MRLNTLSPAEGAKHSAKRLGRGIGSGLGKTGGRGHKGQKSRTGSGVRRGFEGGQMPLYRRLPKFGFTSMKSAVTAEVRLNELTKVEGNVVTLETLKAANILTKDIQFAKVILAGEVKSAVTVRGLRVTKGAKAAIEAAGGSIEE

SEQ ID NO: 233 - protein, 205 aa, Haemophilus influenzae
MKKVLLALGLGVSTLMSVNSFAADLQEGKQYVQVSQQASQQKEVIEFFSFYCPHCYAFEMEYKIPQQVVDALPKDVKFKQYHVNFLGHQSENLTRAWALAMALGAESKVKSPLFEAAQKDALKSMDDIRAIFLSNGITAEQFDGGINSFAVNGLVNKQVNAAEQFKVRGVPDFYVNGKFRVNPEGLNYDDFVKDYVQTVKGLLQK

SEQ ID NO: 234 - protein, 930 aa, Haemophilus influenzae
MAQIATNPLVLVDGSSYLYRAFHAFPSLTNAAGEPTNAMYGVLNMLKRLISQVQPTHIAVVFDAKGKTFRNEMFEQYKSHRPPMPDDLRKQIQPLHDMIRALGIPLLVVEGIEADDVIGTLALQASSLGKKVLISTGDKDMAQLVDDNIMLINTMNNSLLDREGVIEKYGIPPELIIDYLALMGDSADNIPGVAGVGEKTALGLLQGIGSMAEIYANLEKVAELPIRGAKKLGEKLLAEKPNADLSYTLATIKTDVELNVTTDQLLLGESQKDQLIEYFARYEFKRWLNEVMNGADSITQTTEQPVKMNQYQATSQDQSAVENTPKIQIDRTKYETLLTQADLTRWIEKLNTAKLIAVDTETDSLDYMSANLVGISFALENGEAAYLPLQLDYLDAPKTLEKSTALAAIKPILENPDIHKIGQNIKFDESIFARHGIELQGVEFDTMLLSYTLNSTGRHNMDDLAKRYLGHETIAFESIAGKGKNQLTFNQIPLEQATEYAAEDADVTMKLQQALWLKLQQEPTLVELYKTMELPLLHVLSRMERTGVLIDSNALFMQSNEIATRLTALEEQAYELAGQPFNLASTKQLQEILFDKLGLPILQKTPKGAPSTNEEVLEELAYSHELPKILVEHRGLSKLKSTYTDKLPQMVNSQTGRVHTSYHQAVTATGRLSSSDPNLQNIPIRNEEGRRIRQAFIAREGYSIVAADYSQIELRIMAHLSGDQGLINAFSQGKDIHRSTAAEIFGVSLDEVTSEQRRNAKAINFGLIYGMSAFGLSRQLDISRPDAKKYMDLYFQRYPSVQQFMTDIREKAKAQGYVETLFGRRLYLPDINSSNAMRRKGAERVAINAPMQGTAADIIKRAMIKLDEVIYHDPDIEMIMQVHDELVFEVRSEKVEFFREQIKQQMEDASELVVPLIVEVGVGQNWDEAH

SEQ ID NO: 235 - protein, 856 aa, Haemophilus influenzae
MNIEKFTTKFQEALSEAQSLAIGKDNQFIEPVHLLTALLNQQGGSIAPILTASGVNVALLRNELKTELNKLPQVIGNGGDVQLSRQLINLLNLCDKFAQQNQDKFISSELFLLAALEERGTISDILKKCGAKKEQISQAIQHIRGGQNVNDQNAEESRQALEKYTIDLTARAESGKLDPVIGRDEEIRRAIQVLQRRTKNNPVLIGEPGVGKTAIVEGLAQRIVNGEVPEGLKNKRVLSLDMGALIAGAKYRGEFEERLKAVLNELSKEEGRVILFIDEIHTMVGAGKTDGAMDAGNLLKPSLARGELHCVGATTLDEYRQYIEKDAALERRFQKVFVDEPSVEDTIAILRGLKERYEIHHHVDITDPAIVAAATLSHRYISDRQLPDKAIDLIDEAASSIRMEIDSKPEPLDRLERRIIQLKLEQQALQKEEDEASRKRLEMLEKELAEKEREYAELEEVWKSEKATLSGSQHIKQELDTAKTELEQARRAGDLAKMSELQYGRIPALEKQLEQAETSEGKEMTLLRYRVTDEEIAEVLSKATGIPVSKMMEGEKEKLLRMEDELHKRVIGQEEAVDAVANAIRRSRAGLSDPNRPIGSFLFLGPTGVGKTELCKTLAKFLFDSEDAMVRIDMSEFMEKHSVSRLVGAPPGYVGYEEGGYLTEAVRRRPYSVILLDEVEKAHADVFNILLQVLDDGRLTDGQGRTVDFRNTVVIMTSNLGSDLIQGNKDESYSEMKALVMSVVSQHFRPEFINRIDETVVFHPLGKENIRAIASIQLERLAKRMETRGYELVFTDALLDFIGEVGYDPIYGARPLKRAIQQEIENSLAQQILSGALLPGKVVTIDYANAEVQARQ

SEQ ID NO: 236 - protein, 782 aa, Haemophilus influenzae
MTKKRKNLISQDPHYKRELEKYGNPIPSREFILSVIRDNNAPMNRDEILTALSIRNEEQIEAMRRRLRAMENDGQLVFTKRKRYALPEKLDLFKGTVIGHREGFGFLQVDGKKDDLFIPNHQMQRVMHGDFVLAQLAGLDRRGRREVRIVRVLESRKKQIVGRFFLENGFSYVVPDDSRIGRDILVPNEHRNGARMGQVVVVELQERSASFNQPIGVITEILGDNMAKEMEVEIALRNHDIPHKFPSAVEKYVKKFTEEVPEEAKKGRVDLRNLPLVTIDGEDARDFDDAVYCEKHGKGWKLWVAIADVSYYVRLRSALDVEAHNRGNSVYFPNRVVPMLPEILSNGLCSLNPQVDRLCMVCEMQISAKGKLIDYRFYEAVMNSHARLTYTKVAKMLEGDEELRARYSTLVPHLEDLYKLYQALLGARHQRGAIDFETIETKFIFNAMGRIERIEPVVRNDAHKIIEECMILANIAAANFMEKHKEPALYRIHATPSEEKLTSFRTFLSEFGLTLEGGLKPTTKDYAALLEKVKERHDHELIQTMLLRSLSQAVYHADNIGHFGLALEEYAHFTSPIRRYPDLTLHRGIKYLLAKEQGAKRKTTDTGGYHYSFDEMDLLGNHCSMTERRADDATREVADWLKCEYMQDHVGGEFSGVISSVTGFGLFVRLDDLFIDGLVHISTLENDYYQFDAAKQRLIGENSGMQYRLGDKVRIKVEAVHLENKMVDFSLMGSERKPRRAGKTAKEKAKKVFKELPSKTSQKRKSAVKKKDVLKKASRKRK

SEQ ID NO: 237 - protein, 326 aa, Haemophilus influenzae
MNGTICPINQSINQSINQSINQSINQSINQSKSVIIAGNGTSLKSIDYSLLPKDYDVFRCNQFYFEDHYFLGKKIKKVFFNCSVIFEQYYTFMQLIKNNEYEYADIILSSFLNLGDSELKKIQRLEKLLPQIDLGHSYLKKLRAFDAHLQYHELYENKRITSGVYMCAVATAMGYKDLYLTGIDFYQEKGNPYAFHHQTENIIKLLPSFSQNKSQSDIHSMEYDLNALYFLQKHYGVNIYCISPESPLCNYFPLSPLNNPITFILEEKKNYTQDILIPPKFVYKKIGIYSKPRIYQNLIFRLIWDILRLPNDIKHALKAKKMRLRK

SEQ ID NO: 238 - protein, 579 aa, Haemophilus influenzae
MKKLFLFFTLIFTAFAANSGLFDKKQTFLKVDDAFAFSATLSTDKSQLQAHWDIADGYYLYQDKISAELVGKSNPLSLHTQQAAELHQDPYFGEVKVFTHSIDGIFRGTFNNADDKVEITYQGCTEGFCYPPETKVLRIGDLAVSQEQIVEKTVEKNTALLSEQDRLADGLFHSKWTIFGFFLLGLGLAFTPCVLPMLPLLSAIVIGQQQRPNMMRAFSLAFLYVQGMALTYTLLGLAVAAIGLPFQIALQHPYVMIGLSILFVALALSMFGLFTIQLPNSLQNKLNTWSQKQTSGAFGGAFAMGMIAGLVASPCTSAPLSGALLYVAQSGDLFTGAATLYLLALGMGVPLMLITLFGNKILPKSGEWMNTVKQTFGFVMLALPVFLLSRILPEVWEPRLWAGLATVFFIWFALQMSKNGFGYAIKIISFALAMVTVQPLQNWIWQTQTTTQSAVENMPVSQVKFKQIKNTEELDRTLAENPHSIAMLDLYADWCVACKEFEKLTFSDPQVQQQFQNILLLQVNMTKNSPENKALMERFNVMGLPTILFFDQQNNEIQGSRVTGFMDADAFSNWLKALH

SEQ ID NO: 239 - protein, 398 aa, Haemophilus influenzae
MSQTQHQRPKRSHIFLMKIILVVFVLIFVGVIGFNIIKGVMISRAIAEMPESSSPVTALEVQPREWTPVINTTGLVRPNQGALLSTQNAGTISQVLVQNGQNVKKGEVLVELDSSVERANLQAAQAQLSALRQTYQRYVGLLNSNAVSRQEMDNAKAAYDAQLANIESLKAVIERRKIVAPFDGKAGIVKINVGQYVNVGTEIVRVEDTSSMKVDFALSQNDLDKLHIGQRVTATTDARLGETFSARITAIEPAINSSTGLVDVQATFNPEDGHKLLSGMFSRLRIALPTETNQVVVPQVAISYNMYGEIAYLLEPLSEEEKGKMSGNEKLDRLYRAKQITVFTKDRQGVYAQLQGNEVKAGDKIITGGQQGIGNGSLVEWIKKDIVGAVEPAHKTPL

SEQ ID NO: 240 - protein, 390 aa, Haemophilus influenzae
MTKTAIETPSNKSVSNKTNRKKGLSIFILLLLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHANEISLAQAQGNLARRVQLEKMGAIDKESFQHAKEAVELAKANLNASKNQLAANQALLRNVPLREQPQIQNAINSLKQAWLNLQRTKIRSPIDGYVARRNVQVGQAVSVGGALMAVVSNEQMWLEANFKETQLTNMRIGQPVKIHFDLYGKNKEFDGVINGIEMGTGNAFSLLPSQNATGNWIKVVQRVPVRIKLDPQQFTETPLRIGLSATAKVRISDSSGAMLREKTEPKTLFSTDTLKYDESAVENLIESIIQQNSH

SEQ ID NO: 241 - protein, 197 aa, Haemophilus influenzae
MKNIAKVTALALGIALASGYASAEEKIAFINAGYIFQHHPDRQAVADKLDAEFKPVAEKLAASKKEVDDKIAAARKKVEAKVAALEKDAPRLRQADIQKRQQEINKLGAAEDAELQKLMQEQDKKVQEFQAQNEKRQAEERGKLLDSIQTATNNLAKAKGYTYVLDANSVVFAVEGKDITEEVLKSIPASEKAQEKK

SEQ ID NO: 242 - protein, 800 aa, Haemophilus influenzae
MKKLLIASLLFGTTTTVFAAPFVAKDIRVDGVQGDLKQQIRASLPVRAGQRVTDNDVANIVRSLFVSGRFDDVKAHQEGDVLVVSVVAKSIISDVKIKGNSIIPTEALKQNLDANGFKVGDVLIREKLNEFAKSVKEHYASVGRYNATVEPIVNTLPNNRAEILIQINEDDKAKLASLTFKGNESVSSSTLQEQMELQPDSWWKLWGNKFEGAQFEKDLQSIRDYYLNNGYAKAQITKTDVQLNDEKTKVNVTIDVNEGLQYDLRSARIIGNLGGMSAELEPLLSALHLNDTFRRSDIADVENAIKAKLGERGYGSATVNSVPDFDDANKTLAITLVVDAGRRLTVRQLRFEGNTVSADSTLRQEMRQQEGTWYNSQLVELGKIRLDRTGFFETVENRIDPINGSNDEVDVVYKVKERNTGSINFGIGYGTESGISYQASVKQDNFLGTGAAVSIAGTKNDYGTSVNLGYTEPYFTKDGVSLGGNVFFENYDNSKSDTSSNYKRTTYGSNVTLGFPVNENNSYYVGLGHTYNKISNFALEYNRNLYIQSMKFKGNGIKTNDFDFSFGWNYNSLNRGYFPTKGVKASLGGRVTIPGSDNKYYKLSADVQGFYPLDRDHLWVVSAKASAGYANGFGNKRLPFYQTYTAGGIGSLRGFAYGSIGPNAIYAAQNGNSNSNSNGTFNKISSDVIGGNAITTASAELIVPTPFVSDKSQNTVRTSLFVDAASVWNTKWKSDKSGLDNNVLKSLPDYGKSSRIRASTGVGFQWQSPIGPLVFSYAKPIKKYENDDVEQFQFSIGGSF

SEQ ID NO: 243 - protein, 443 aa, Haemophilus influenzae
MSFLWSLGSFIIAIAVLVSVHEYGHFWAARKCGIKVHRFSIGFGKVIWKRIDKYGTEFAVSMIPLGGYVKMLDGRNEVVPAEQKSQAFDSKSVLQRAFVIIAGPLANFIFAIFAYWIIYLYGMPTVKPVIQSITPSSIAAQAHIEPNTQILAVDGEETQDWETINMLLATKMGEPNVEITLSPFNSNIEQQRTLNLTNWIFDPEKESAFEALGIMPMRPKIEMVLSKVVQNSPAEKAGLQIGDKILKENLTALPWQDFIKQVEQGESFSIKVERNGETFDKVLTPVRNQNGKWFVGVSPTLTKLADEYRTELKYGILESLQKGIEKTGQLSLLTLKILGKLLTGDLSLNNLSGPISIAKGAGASANIGLVYFLSFMALISVNLGIMNLFPLPVLDGGHLVFLTMEAVKGKPVSERVQSICYRIGAALLLSLTVFALFNDFLRL

SEQ ID NO: 244 - protein, 722 aa, Haemophilus influenzae
MTTQNFLVEIGTEELPPKALKTLATSFADNVEAELNQAGLSFDKIEWFAAPRRLAVKVLNLATQQPSKEIEKRGPAVSAAFDAEGKPTKAAEGWARGCGITVEQAERIATDKGEWLVHRTKIKGQPTKNLLNDIVANALAKLPIPKPMRWADKTVQFIRPVHTVTMLLGDELIEGEILGVASARTIRGHRFLGEKEFDIQHADQYPQLLRDKGSVVADFNERKAEILAKSQAKATALGGVADIEESLLEEVTSLVEYPNVLAAKFEERFLAVPAEALVYTMKGDQKYFPIYDKDGRLLPHFIFVSNINPEDPTAIIEGNEKVVRPRLTDAEFFFKTDLKQKLVDRLPRLETVLFQQQLGTLKDKTDRIEQLAGEIAKQIGADEAKAKRAGLLSKCDLMTNMVFEFTDTQGVMGMHYARHDGEDEEVAVALNEQYMPRFAGDELPKSLVASAVALADKFDTLTGIFGIGQAPKGSADPFALRRAALGALRIIVEKNLPLDLNDIISKAFDLYKELDNERLRNAPIAKTRGGFSEYPEGYVSFFTRGDDLVPKQKILDEVVDFMLGRFRAWYQDEGIAVDVIQAVLARRPTRPADFDARVRAVSHFRTLDSAEALAAANKRVSNILAKAGAAIGEINLTACVEPAEKALAEAVLALRTEVQPLIAQGDYTAVLDKLANLRAPVDSFFDNVMVNAEDPALRQNRLAILNTLQGLFLQVADISVLQ

SEQ ID NO: 245 - protein, 138 aa, Haemophilus influenzae
MTLQKFLLPPLLFLSINTFAAPAYLLFGGDNHDKFLGCLNCSKHDNSSIWNKYGEFGSKYNSDSIWNKYGTYGSKYNSESPWNKYSTSGPVIVDNEGNFYGKFTTNKYDNQTRIKSLLWILENHEYIIENINDVIDKM

SEQ ID NO: 246 - protein, 149 aa, Haemophilus influenzae
MHCPFCDTEETKVIDSRLVSDGYQVRRRRECGHCHERFTTFEMAELIIPKIIKTDGTREPFNEDKLRSGIQHALEKRPVSADDVEKAINHIILQLRATGEREVPSKLVGKLAMNELKKLDKVAYIRFASVYLSFDDIDQFTIEIEKLKD

SEQ ID NO: 247 - protein, 151 aa, Haemophilus influenzae
MKKIDVKILDSRIGNEFPLPTYATEGSAGLDLRALIDESFEIQPGETKLIPTGLSIYIADPNLAAVILPRSGLGHKHGIVLGNLVGLIDSDYQGPLMVSMWNRGNEPFKIEVGDRIAQLVFVPVVQAEFNIVEDFQQTERGEGGFGHSGKQ

SEQ ID NO: 248 - protein, 448 aa, Haemophilus influenzae
MLEKVVIANRGEIALRILRACKELGIKTVAVHSTADRDLKHVLLADETVCIGPAPSAKSYLNIPAIIAAAEVTGADAIHPGYGFLSENADFAEQVERSGFTFIGPTADVIRLMGDKVSAIKAMKKAGVPCVPGSDGPVGNDIAKNKEIAKRIGYPIIIKASGGGGGRGMRVVRSEDALEESIAMTKAEAKAAFNNDMVYMEKYLENPRHVEIQVLSDTHGNAVYLAERDCSMQRRHQKVVEEAPAPGITEEVRRDIGSRCAKACVEIGYRGAGTFEFLYENGEFYFIEMNTRIQVEHPVTEMITGVDLVKEQLRIAAGLPISFKQEDIKVKGHAMECRINAEDPKTFLPSPGKINHLHSPGGLGVRWDSHVYGGYTVPPHYDSMIAKLITYGDTREIAIRRMQNALSETIIDGIKTNIPLHELILEDENFQKGGTNIHYLEKKLGMNE

SEQ ID NO: 249 - protein, 515 aa, Haemophilus influenzae
MTDRVIIFDTTLRDGEQALKASLTVKEKLQIALALERLGVDVMEVGFPVSSQGDFESVQTIARHIKNARVAALSRAVDKDIDAAYQALKVAEAFRIHTFIASSALHVEAKLKRSFDDVVGMAVAAVKRARNYTDDVEFSCEDAGRTGIDNICRIVEAAINAGATTVNIPDTVGFCLPNEYGNIIAQVRNRVPNIDKAVISVHCHNDLGMATANSLTAVQNGARQIECTINGIGERAGNTSLEEVVMAMKVRQDFMGVDTRINTQEIHRVSQMVSQLCNMPIQPNKAIVGSNAFAHSSGIHQDGMLKNKNTYEIMSPETIGLKKEKLNLTARSGRAAVKGHMADMGYNEQDYDLDKLYDAFLKLADKKGQVFDYDLEALAFIDMQQGDEDRLVLDKLSAHSTKEYPATAFVQLKLDGEKLSTSSIGGNGPVDAVYNAILNLTGLEIKMSHYNLTAKGEGAEALGQVDIVVEHKGRKFHGVGLATDIVESSALALVHAINAIYRAHKVADIKSHKHH

SEQ ID NO: 250 - protein, 1794 aa, Haemophilus influenzae
MLNKKFKLNFIALTVAYALTPYTEAALVRNDVDYQIFRDFAENKGKFSVGATNVEVRDNKNNNLGSALPKDIPMIDFSAVDVDKRIATLVNPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWTSKGNTSLISGTSESLSVDLVDNKNLNHGKNVTFEGSGNLTLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVERRNQTVDTPSIATANNMQADVPSVSNNHEETARVEAPIPLPAPPAPATGSAMANEQPETRPAETVQPTMEDTNTTHPSGSEPQADTTQADDPNSESVPSETIEKVAENSPQESETVAKNEQKATETTAQNDEVAKEAKPTVEANTQTNELAQNGSETEETQEAETARQSEINSTEETVVEDDPTISEPKSRPRRSISSSSNNINLAGTEDTAKVETEKTQEAPQVAFQASPKQEEPEMAKQQEQPKTVQSQAQPETTTQQAEPARENVSTVNNVKEAQPQAKPTTVAAKETTASNSEQKETAQPVANPKTAENKAENPQSTETTDENIHQPEAHTAVASTEVVTPENATTPIKPVENKTTEAEQPVTETTTVSTENPVVKNPENTTPATTQSTVNSEAVQSETATTEAVVSQSKVTSAEETTVASTQETTVDNSGSTPQPRSRRTRRSAQNSYEPVELHTENAENPQSGNDVATQLVLRDLTSTNTNAVISDAMAKAQFVALNVGKAVSQHISQLEMNNEGQYNVWVSNTSMKENYSSSQYRHFSSKSAQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALAKDRIKVNPISVKTAFAQVDLSYTYHLGEFSITPILSARYDANQGSGKINVDRYDFAYNVENQQQYNAGLKLKYHNVKLSLIGGLTKAKQAEKQKTAEVKLSFSF

SEQ ID NO: 251 - protein, 912 aa, Haemophilus influenzae
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIAKEDGSNAYFVMEDECPKDYNSCIPSAKPPAKLSSQRETVSVSDYTGANRIKPNPMKYESQSWFLRGGYHFSEQHYIGGIFEFTQQKFDIRDMTFPAYLRSTEKPDLENSSFYPKQDYGAYQRIEDGRGVKYASGLYFDEHHRKQRVGIEYIYENKNKAGIIDKAVLSANQQNIILDSYMQHTHCSLYPNPSKNCRPTLDKPYSYYHSDRNVYKEKHNMLQLNLEKKIQQNWLTHQIVFNLGFDDFTSALQHKDYLTRRVTATAKSISEKPGETPRRNGFKLQPYLYPKPNASFVGRDHCNYQGSSSNYSDCKVRLIKGKNYYFAARNNMALGKYVDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELKNGKGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRGVKSTRKLTRAWHILDVSGYYMVNRSILFRLGVYNLLNYRYVTWEAVRQTAQGAVNQHQNVGNYTRYAASGRNYTLTLEMKF

SEQ ID NO: 252 - protein, 630 aa, Haemophilus influenzae
MKSVPLITGGLSFLLSACSGGGGSFDVDDVSNPSSSKPRYQDDTSSSRTKSNLEKLSIPSLGGGMKLVAQNLSGNKEPSFLNENGYISYFSSPSTIEDDVKNVKTENKIHTNPIGLEPNRALQDPNLQKYVYSGLYYIENWKDFSKLATEKKAYSGHYGYAFYYGNKTATDLPVSGVATYKGTWDFITATKYGQNYSLFSNARGQAYFRRSATRGDIDLENNSKNGDIGLISEFSADFGTKKLTGQLSYTKRKTDIQQYEKEKLYDIDAHIYSNRFRGKVTPTKSTSDEHPFTSEGTLEGGFYGPNAEELGGKFLARDKRVFGVFSAKETPETEKEKLSKETLIDGKLITFSTKTADATTSTTASTTADVKTDEKNFTTKDISSFGEADYLLIDNYPVPLFPEGDTDDFVTSKHHDIGNKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQVEKTNK

SEQ ID NO: 253 - protein, 541 aa, Haemophilus influenzae
MDSRRSLLVLALIFISFLVYQQWQLDKNPPVQTEQTTSITATSDVPASSPSNSQAIADSQTRGRIITLENDVFRLKIDTLGGDVISSELLKYDAELDSKTPFELLKDTKEHIYIAQSGLIGKNGIDTRSGRAQYQIEGDNFKLAEGQESLSVPLLFEKDGVTYQKIFVLKRGSYDLGVDYKIDNQSGQAIEVEPYGQLKHSIIESSGNVAMPTYTGGAYSSSETNYKKYSFADMQDNNLSIDTKAGWVAVLQHYFVSAWIPNQDVNNQLYTITDSKNNVASIGYRGPVVTIPAGSQETITSSLWTGPKLQNQMATVANNLDLTVDYGWAWFIAKPLFWLLTFIQGIVSNWGLAIICVTIVVKAILYPLTKAQYTSMAKMRILQPKMQEMRERFGDDRQRMSQEMMKLYKEEKVNPLGGCLPILLQMPIFIALYWTFLEAVELRHAPFFGWIQDLSAQDPYYILPILMGISMFLLQKMSPTPVTDPTQQKVMNFMPLVFMFFFLWFPSGLVLYWLVSNLITIAQQQLIYRGLEKKGLHSRKK

SEQ ID NO: 254 - protein, 333 aa, Haemophilus influenzae
MLAEKLQINSITPHPSVEYWSVCKVEALFETPFLELVYRATQVHRKHFNPRAIQLSTLMSIKTGGCPEDCSYCPQSARYHTGVQNQQLLDVDEIVAKAKIAKARGAGRFCMGAAWRGPKPKDIEKVTEIIKAVKSLGLETCGTFGLLQDGMAEDLKEAGLDYYNHNLDTAPEHYAEVIGTRRFDDRLSTLGKVRKAGLKVCCGGIVGMNETRKERAGLIASLANLDPQPESVPINQLVKVEGTPLADAEELDWTEFVRTIAVARITMPKSYVRLSAGRSGMTEEMQAMCFMAGANSIFYGDKLLVTDNPEEDGDQLLMAKLDLEPETAENKKL

SEQ ID NO: 255 - protein, 400 aa, Haemophilus influenzae
MSKTMISRENYLQQLIQFKDTDFIKVISGVRRSGKSVLLMQYRDYLQQQGIASENILYLNFESFEYQWVKDAQDFQQLIQEKMPSSQKKIYFLIDEIQFVEGWQKIVNGLRVSFNADIVITGSNANLLSGELATLLSGRYVEIKIYPLSFKEFLHAKNVDSQSRLVDKLYSEYEKYGGFPSVVMADEPLKETILSGIFDSIVLNDIAHRAGVKDTHILKSVILFLADNVGQLVNPSKISNTLTSERVPTSNHTISKYLDLLENAFLFYKAKQYDIRGKGYLKTNAKYFIVDNGLRRHAIGKKGANYANRLENIVFIELLRRGYTVDVGKLDSKEIDFIARKADEILYVQVAFEIPENTHETDNLLHIKDNYKKILITGKYYEQTEIDGIEVIYVVDWLLQ

SEQ ID NO: 256 - protein, 806 aa, Haemophilus influenzae
MSNFNQISRRDFVKASSAGAALAVSNLTLPFNVMAKETQHLNENSQERIVWSACTVNCGSRCPLRMHVKDNRITYVETDNTGTETYNLDHQVRACLRGRSMRRRVYNPDRLKYPMKRIGKRGEGKFKRISWDEALTEIADALKRNIKKYGNESIYLNYGTGTLGGTMAKSWPPASTMIARFMNCIGGYLNHYGDYSTAQIAVGLDYTYGGGWALGNGMADIENTKLIVLFGNNPAETRMSGGGLTYCIEQAKARSNAKMIIIDPRYNDTGAGREDEWIPIRPGTDAALVSALAYVMIQENLVDQPFLDKYCVGYDEKTLPADAPKNGHYKAYILGYGNDGIAKTPEWAAKITGIPAERIIKLAREIGSTKPAFISQGWGPQRRSNGELISRAIAMLPILTGNVGIHGGNTGARESAYSIPFVRMPTLKNPVKASIPMFLWTDAIIRGTEMTALTDGIRGVDKLSSPIKVIWNYASNCLINQHAQINRTHDILQDDTQCEMIITIDNHMTSTAKYSDILLPDCTTSEQMDFALDAFVSNMAYVIFADQVIKPSFECRPIYDMLSDLAEKMGVKEKFTEGRTQEEWLRHIYEQSREKLPELPTFEEFRQQGIFKKVDPNGFKVAYKDFRDNPEAHPLKTPSGKIEIYSSRLAEIANTWKLAEDEIIHPLPIHAQSFEHYGDPLMEKYPLQLSGFHYKARTHSTYGNVDVLKAANPQEVWMNPIDAEPRNIKNGDMIRIFNDRGEVRINVKITPRIIPGVVALSEGAWYAPDKDRIDHSGCINVLTTQRPSPLAKGNPQHSNLVQVERL

SEQ ID NO: 257 - protein, 1278 aa, Haemophilus influenzae
MRVDQRRLSARIHGIGKIKSQEAQQAVAAEIQQQIEQARLRVEQRKSAVQNPIIFPESLPVSQRKVEIQKLLSEHQVIVVAGETGSGKTTQLPKMCLELGFGNLGMIGHTQPRRIAARSVAARIAEELETELGDLVGYKVRFNDQISDNTQIKLMTDGILLAEIQNDRFLNQYSCLIIDEAHERSLNNDFILGYLKQLLPRRRDLKLIITSATIDVERFSKHFNNAPIIEVSGRTYPVEVRYRPVVEDDQDQLQGILNAVDELQAEGRGDILIFMNGEREIRDTAEALQKQNLKYTEILPLFARLSAQEQNKIFHPSGLNRIVLATNVAETSLTVPGIKYVIDPGTARISRYSYRTKVQRLPIEPISQASANQRKGRCGRVSEGICIRLYSEEDFNSRPEFTDPEILRTNLASVILQMTALGLDDIEAFPFVDAPDKRHIQDGIKLLEELGAFETVQTKSGEKRLLTRVGRQLAQLPVDPRLAKMILSAVNFGCVYEMMIIVSALSIQDPRERPQEKQQASDEKHRRFADKKSDFLAFLNLWYYLQEQQKELSKNQFRRQCQKDFLNYLRIREWQDIYHQIRLTVREMGLPINSEKAEYQQIHTALLSGLLSHIGLKEAEKQQYLGARNAHFAIFPNSVLFKKQPKWVMAAELVETSKLWGRMVAEIEPEWIEPLAEHLIKKSYSEPRWSKSRGAVIADEKVTLYGVPIVAARPVNYGAIDPTVSREIFIQSALVEGGWNTKHKFFKENQRLVQEVEELEHKSRRRDILVDDRTLFEFYDQRIGTEVVSQKHFDTWWKKVQQKDPELLNFERSFLINDDAEQVSKLDFPNFWYQGNLKLKLTYQFEPGTDADGVTVHIPLPLLNQVEMTGFDWQIPGLREELVIALIKSLPKSYRRNFVPAPNYTQAFLSRAVPLEKPLLDTLIYELRRMTGVTVEAEHWNWEQIPSHLKMTFRVVDENGKKIAESMNLDELKFNLKDRVQESISAVADDGIEQSRLHIWSFADLPQCYEQKQRGFSVKAFPAIVDEKDAVGIKLFETEFEQSVAMQQGLRRLLLLNVPSPIKYLHEKLPNKAKLGLYFTPFGRVLDLIDDCIACAVDKLIANFGGFVWDEAGFEKLRDFVRENLNEVTVDIAQKVEQILTLTYQLNQRLKGKMDFTMAFALSDIKSQLAGLVYQGFVQKSGYDRLPDLQRYLQAIDKRIDKLAQDVNRDRAAMLRVEQVQQAYQQLLAKLPKSKPISDEIAEIRYMIEELRVSLFAQQLGTKYQISDKRIANIISQY

SEQ ID NO: 258 - protein, 545 aa, Haemophilus influenzae
MATNYIFVTGGVVSSLGKGIAAASLAAILEARGLNVTIMKLDPYINVDPGTMSPTQHGEVFVTQDGAETDLDLGHYERFIRTKMTKRNNFTTGKIYSEVLRKERRGDYLGATIQVIPHITNEIKDRVIAGAQGHDVVIVEVGGTVGDIESLPFLEALRQLAVQVGREHTLFMHLTLVPYIPTAGEVKTKPTQHSVKELLSIGIQPDVLICRSDRMIPPNERAKIALFCNVAERAVISLKDVNSIYQIPALLKSQGLDDFVCERFRLTCPEADLTEWEQVLYKQANPVGEVTIGMVGKYTELPDAYKSVNEALKHAGLTNRLSVSIKYIDSQDVETKGVEVLKGVDGILVPGGFGYRGVEGKIRTAQYARENKIPYLGICLGMQIALIEYARNVAGLTKANSSEFDKDCEQPVVALITEWQDAEGNTEVRTDESDLGGTMRLGAQQCHLVSGSHARELYGKETIEERHRHRYEVNNTLLPQIEKAGLKVTGLSADKKLVEIIEVPNHPWFVACQFHPEFTSTPRDGHPLFAGFVKAAYENHKKSVK

SEQ ID NO: 259 - protein, 424 aa, Haemophilus influenzae
MDKFRVYGQSRLSGSVNISGAKNAALPILFAAILATEPVKLTNVPELKDIETTLNILRQLGVIANRDETGAVLLDASNINHFTAPYELVKTMRASIWALAPLVARFHQAQVSLPGGCSIGARPVDLHISGLEKLGADIVLEEGYVKAQVSDRLVGTRIVIEKVSVGATLSIMMAATLAKGTTVIENAAREPEIVDTADFLNKMGAKITGAGSDHITTEGVERLTGCEHSIVPDRIETGTFLIAAAISGGRVVCQNTKADTLDAVIDKLREAGAQVDVTENSITLDMLGNRPKAVNIRTAPHPGFPTDMQAQFTLLNMVAEGTSIITETIFENRFMHIPELIRMGGKAEIEGNTAVCHGVEQLSGTEVIATDLRASISLVLAGCIATGETIVDRIYHIDRGYEHIEDKLRALGAKIERFSRSDEA

SEQ ID NO: 260 - protein, 212 aa, Haemophilus influenzae
MFEQHKLSLQNLSCQRGERVLFRALTCDFNSGDFVQIEGHNGIGKTSLLRILAGLAQPLEGEVRWDAEAISKQREQYHQNLLYLGHLLGVKPELTAWENLQFYQRISQAEQNTDMLWDLLEKVGLLGREDLPAAQLSAGQQKRIALGRLWLSQAPLWILDEPFTAIDKKGVEILTALFDEHAQRGGIVLLTSHQEVPSSHLQKLNLAAYKAE

SEQ ID NO: 261 - protein, 670 aa, Haemophilus influenzae
MTNIQTQLDNLRKTLRQYEYEYHVLDNPSVPDSEYDRLFHQLKALELEHPEFLTSDSPTQRVGAKPLSGFSQIRHEIPMLSLDNAFSDAEFNAFVKRIEDRLILLPKPLTFCCEPKLDGLAVSILYVNGELTQAATRGDGTTGEDITANIRTIRNVPLQLLTDNPPARLEVRGEVFMPHAGFERLNKYALEHNEKTFANPRNAAAGSLRQLDPNITSKRPLVLNAYGIGIAEGIDLPTTHYDRLQWLKSIGIPVNPEIRLCNGADEVLGFYRDIQNKRSSLGYDIDGTVLKINDIALQNELGFISKAPRWAIAYKFPAQEELTLLNDVEFQVGRTGAITPVAKLEPVFVAGVTVSNATLHNGDEIERLNIAIGDTVVIRRAGDVIPQIIGVLHERRPDNAKPIIFPTNCPVCDSQIIRIEGEAVARCTGGLFCAAQRKEALKHFVSRKAMDIDGVGGKLIEQLVDRELIHTPADLFKLDLTTLTRLERMGAKSAENALNSLENAKSTTLDRFIFALGIREVGEATALNLANHFKTLDALKDANLEELQQVPDVGEVVANRIFIFWREAHNVAVVEDLIAQGVHWETVEVKEASENLFKDKTVVLTGTLTQMGRNEAKALLQQLGAKVSGSVSSKTDFVIAGDGAGSKLAKAQELNITVLTEEEFLAQITR

SEQ ID NO: 262 - protein, 328 aa, Haemophilus influenzae
MDLNTILIIVGIVALVALIVHGLWSNRREKSKYFDKANKFDRTSPTSRSHTQEEMVQPNNISPNTYVENGHTPISQPTTEKLPSEAELIDYRQSDKSVDDIKISIPNTQPIYDMGNHRSEPIQPTQPQYDMPTANNVASMTLEQLEAQSQNVGFNGINSSSPELRVQLAELSHEEHQVDYNLSFNEPKAETTAQPKQTTGYIQLYLIPKSSEEFNGAKLVQALENLGFILGKDEMYHRHLDLSVASPVLFSVANLEQPGTFNAYNLAEFNTIGIVLFMQLPSPGNNLANLRMMMRAAHTLAEDLQGVILTEEQEIFDANAEQAYLARV

SEQ ID NO: 263 - protein, 332 aa, Haemophilus influenzae
MTVSNNKELLLEVNHLGVSFKIKNDKSLFFAKPQTLKAVKDVSFKLYAGETLGVVGESGCGKSTLARAIIGLVEASEGEILWLGKHLRKQSAKQWKETRKDIQMIFQDPLASLNPRMNIGEIIAEPLKIYQPHLSAAEVKEKVQAMMLKVGLLPNLINRYPHEFSGGQCQRIGIARALIIEPKMIICDEPVSALDVSIQAQVVNLLKSLQKEMGLSLIFIAHDLAVVKHISDRVLVMYLGNAMELGSDVEVYNDTKHPYTKALMSAVPIPDPKLERNKSIELLEGDLPSPINPPSGCVFRTRCLKADENCAKQKPPFTSQNNSHFVACLKVL

SEQ ID NO: 264 - protein, 541 aa, Haemophilus influenzae
MQHKLLFSAIALALSYSVQAVIVPEGTQLDEKQHIVINNGAEPQSFDPHKTEGVPESNVAYQLLEGLVTSDSEGKLQPGAAESWENTPDFKTWTFHLRKDAKWSNGDPVTAHDFVFAWRRLVDPATAAPYASYLSYLQVENAQDIIDGKKKPAELGVEAKDDYTFVVHATNPVPYAVSLTTHQSLLPLPQKVVEKLGDAWVKKENYVGNGAYKLANHIINEKIEFERNPLYWNDKETVINSATFLAIENPSTDVARYRAGDLDMTSYGLPPEQFAKLKKELLGEVYVTRTLGTYSYELNNKKAPFDNVNIRKALNLSLDRNVITDKVLGQGQTPTYVFTPTYIEEGHLIQQPAYSKEPMAQRNEEAIKLLEEAGYSKANPLKFSILYNTNENHKKVAIAAASMWKANTKGLIDVKLENQEWKTYIDSRRAGRYDVARAGWHADYNQATTFGNYFLSNSSNNTAKYANPEYDKAMAESYAATDAEGRAKAYAKAEEILGKDYGIVPIFNYVNPRLVKPYVKGYSGKDPQDHIYLRNLYIIKH

SEQ ID NO: 265 - protein, 610 aa, Haemophilus influenzae
MVKFNSSRKSGKSKKTIRKLTAPETVKQNKSQKVFEKCFMRGRYMLSTVLILLGLCALVARAAYVQSINADTLSNEADKRSLRKDEVLSVRGSILDRNGQLLSVSVPMSAIVADPKTMLKENSLADKERIAALAEELGMTENDLVKKIEKNSKSGYLYLARQVELSKANYIRRLKIKGIILETEHRRFYPRVEEAAHVVGYTDIDGNGIEGIEKSFNSLLVGKDGSRTVRKDKRGNIVAHISDEKKYDAQDVTLSIDEKLQSMVYREIKKAVSENNAESGTAVLVDVRTGEVLAMATAPSYNPNNRVGVKSELMRNRAITDTFEPGSTVKPFVVLTALQRGVVKRDEIIDTTSFKLSGKEIVDVAPRAQQTLDEILMNSSNRGVSRLALRMPPSALMETYQNAGLSKPTDLGLIGEQVGILNANRKRWADIERATVAYGYGITATPLQIARAYATLGSFGVYRPLSITKVDPPVIGKRVFSEKITKDIVGILEKVAIKNKRTMVEGYRVGVKTGTARKIENGHYVNKYVAFTAGIAPISDPRYALVVLINDPKAGEYYGGAVSAPVFSNIMGYALRANAIPQDAEAAENTTTKSAKRIVYIGEHKNQKVN

SEQ ID NO: 266 - protein, 488 aa, Haemophilus influenzae
MKKLTALFNLPELKNDIELHNMVLDSRKVKAGDLFVAIKGHQVDGNQFIDSALHSGASAVVSETELSSEHLTVAFIRNVPVVKYYQLARHLSSLADVFYDSPSKNLTLVGVTGTNGKTTISQLLAQWAELLGHRAAVMGTIGNGLLGQIVEAKNTTGSAVEIQSSLSTFKHAGADFTSIEVSSHGLAQHRVEALHFKAAIFTNLTRDHLDYHQSMENYAAAKKRLFTELDTQIKVINADDEIGYQWLTELPDAIAVSMNADFKVGSHQWMKAINIHYHFKGADITFESSWGNGVLHSPLIGAFNVSNLLLVMTTLLSFGYPLENLLATAKSLKGVCGRMEMIQYPNKPIVIVDYAHTPDALEKALIAAREHCQGELWCIFGCGGDRDRGKRPLMAQVAEQFAEKIIVTKDNPRTEPQSQIEADIVAGFKNMEKVGIIPDRAQAIQFAIESAVENDVILIAGKGHEHYQIIGSEVVHFSDQEIALDFLK

SEQ ID NO: 267 - protein, 306 aa, Haemophilus influenzae
MNLKQEKIAVLLGGTSAEREVSFNSGKAVLEALLKQGYNAHPIDPKEYNVANLKKDGFNRAFNILHGRGGEDGTMQGLLEQIGLPYTGCGVMASALTMDKMRTKMLWKAFGLPVADMKVVTRETFSELDPQAVVAKLGLPLMVKPSLEGSSVGLTKVKAVEELKSAVEYALKFDNTILIEEWLAGDELTVPVLDNQVLPAIRIVPEGEFYDYEAKYISDNTQYFCPAGLTPEREQELAILVKRAYDALGCRGWSRIDVMCDAKGNFRLVEVNTNPGMTSHSLFPKSAATVGISFEQLVVKILELSL

SEQ ID NO: 268 - protein, 440 aa, Haemophilus influenzae
MLLVNLAIFIAFLLLLAQLYRKTEKLGQTVFIGLLLGLLFGAVLQSAFEKPLLDETLDWINVVGNGYVRLLQMIVMPLVFVSILSAIARINQTRSLGKVSVGVLSTLLITTAISAAIGIAMVHLFDVSAAGLIVGDRELAAQGKVLDKAGQVSNLTVPAMLVSFIPKNPFADLTGANPTSIISVVIFSALLGVAALSLGKEDQALGERIAQGVETLNKLVMRLVRFVIRLTPYGVFALMIKMAATSKWADIVNLGNFIVASYAAIALMFVVHGILLFFVKVNPVDYYKKVLPTLSFAFTSRSSAATIPLNIETQTAKLGNNNVIANFAASFGATIGQNGCGGIYPAMLAVMVAPMVGIDPFSFSYILTLIFVVAISSFGIAGVGGGATFAAIVVLSTLGLPLELVGLLISIEPIIDMGRTALNVNGAMVAGTITDRLLNK

SEQ ID NO: 269 - protein, 586 aa, Haemophilus influenzae
MNKLRQKYLQKWLRAQQEPIKKLMRANIVLATLSSFILVAQTYFLATLLDKLIMQNVPRDELIPYFLGLIIGFGMRAIILWAREKIGFQSGQLLRNHIRQKILDKIHLVGPATINQKPAGSWASIMLEQVENLHNFYARFLPQQSLSAIVPVVIFIAVFPLNWAAGLILMITAPLVPLFMIIVGIAAADNSQKNMDTLSRLSAQFLDRLRGLETLRLFNRTSEQTEHIENATEDFRETTMDVLKLAFLSSAVLEFFTSISIALMAVYFGFSYLGQIEFGTYNAPLTLFTGFFCLILAPEFYQPLRDLGTYYHDRAAGIGAADAIVDFLESDYLTVHQNEKTISLESAVEISAENLVVLSTQGSALTKPLNFQIPANHNVALVGQSGAGKTSLINAILGFLPYEGSLKINGQELRESNLADWRKHIAWVGQNPLLLQGTIKENLLLGNIQANDEEINQALMRSQAKEFTDKLGLHHEIKDGGLGISVGQAQRLAIARALLRKGDLLLLDEPTASLDAQSENLVLQALNEASQHQTTLMITHRIEDLKQCDQIFVMQRGEIVQQGKFTELQHQGFFAELLAQRQQDIQ

SEQ ID NO: 270 - protein, 359 aa, Haemophilus influenzae
MKKTAIALVVAGLAAASVAQAAPQENTFYAGVKAGQGSFHDGINNNGAIKQNLSSANYGYRRNTFTYGVFGGYQILNQDNFGLAAELGYDNFGRVKLREAGKPKAKHTNHGAHLSLKGSYEVLDGLDVYGKAGVALVRSDYKFYEVANGTRDHKKGRHTARASGLFAVGAEYAVLPELAVRLEYQWLTRVGKYRPQDKPNTAINYNPWIGSINAGISYRFGQGEAPVVAAPEMVSKTFSLNSDVTFAFGKANLKPQAQATLDSVYGEISQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 271 - protein, 170 aa, Haemophilus influenzae
MKKSLLAVIVGAFAFASVANANIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIELGYGVVAGAKYKLDGNWYANGGVEYNRLGNFDSTKVNNYGAKVGVGYGF

SEQ ID NO: 272 - protein, 915 aa, Haemophilus influenzae
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNDAGQWTPDLSKNAWSCNEDPPRLAENIENVKCTHYSFDPRKNDRKEILKKLKAGTKPENIDELQNGKDGIKETDKSFERNKDQYSVAPIEPGSLQSRSRSHLLKFEYGDDHQNLGAQIRTLDNKIGSRKIENRNYQVNYNFNNNNYLDLNLMAAHNIGKTIYPKGGFFAGWRVADKLITKNVANIVDINNSHTFLLPKEIDLKTTLGFNYFTNEYSKNRFPEELSLFYNDDSHDQGNYSNLGRFRGNRNLLPQRSVILQPSGKQKFKTVYFDTALSKGIYHLNYSVNFTHYAFNGEYVGYENTANQINEPILHKSGHKKAFNHSATLSAELSDYFMPFFTYSRTHRMPNIQEMFFSQVSNAGVNTALKPEQSDTYQLGFNTYKKGLFTQDDVLGIKLVGYRSFIKNYIHNVYGVWWRDGVVPTWADSTGFRFTIAHQNYQPIVKKSGAELELNYDMGRFFANVSYAYQRTNQPTNYADASSRPNNASKEDILKQGYGLSRVSMLPKDYGRLEIGTRWFDQKLTLGMAARYYGKSKRATIEEEYINGSHFELKTSGKRTYYVVKKTEEIKKQPIILDLHVSYEPIKDLIIKAEVQNLLDKRYVDPLDAGNDAASQRYYSSLNDSICSKSQDCEDGGKDKTVLYNFARGRTYILSLNYKF

SEQ ID NO: 273 - protein, 879 aa, Haemophilus influenzae
MTQEYSTLRNNISMLGRFLGETINDAQGEDILELIENIRKLSRNSRAGDDKARQALLDTLGSISNENIIPVARAFSQFLNLTNIAEQYQTISREHSLAQSSSQSLSELFKRLKEQNASVEEVHKTVEKLLIELVLTAHPTETTRRSLIHKHIEINKCLSKLEHHDLTEKERNIIERLLLRLIAEAWHTNEIRTVRPTPFDEAKWGFAMLENSLWQAVPEFLRQLNETAREFLGYDLPVGLKPVRISSWMGGDRDGNPFVTAQITKKVLYFARWKAADLFLQDISKLADELSMMKCSDEFRDKYGEHLEPYRFVVKNLRNQLTATLAYFDDHLSNRTPRVSESEIILEDNQLWEPLYDCYQSLIQCGMRIIANGSLLDILHRISCFGVTLSQMDIRQESTRHTDAIAEIMRYIGLGDYSQWMEDDKQAFLIRELSSRRPLIPQNWTPSPETKEILDTCKVIAQQKQGVIACYVISMARSASDVLAVHLLLKEAGVPYHIPVVPLFETLEDLDAAEKVMTQLFNVGWYRGVINNRQMVMIGYSDSAKDAGMMAASWAQYRAQEALVNLTEKLGIELTLFHGRGGTIGRGGAPAHAALLSQPPRSLKNGLRVTEQGEMIRFKLGLPAVAVETFDLYASAILEANLLPPPEPKPEWRTIMDELSTISCDIYRGVVRGDKDFVPYFRSATPEQELSKLPLGSRPAKRNPNGGVESLRAIPWIFAWMQNRLMLPAWLGAGAAIRQVIEQGKGDIIHKMCENWPFFSTRIGMLEMVFSKSDTWLSQQYDQRLVKKELWYLGENLRKQLEDDIQTVLSLSHQSELMSDLPWIADSIALRNIYTDPLNLLQVELLHRFRENPEQVNPDVEQALMITITGIAAGMRNTG

SEQ ID NO: 274 - protein, 396 aa, Haemophilus influenzae
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 275 - protein, 650 aa, Haemophilus influenzae
MTKENLQNAPQNTTVSLVESNNNQTSPQMLQQSPKPSLLRLEQHIEKKDYEFACRELMVILEKMDANFGGVHDIEFDAPAQLAYLPEKLLIHFATRLANAITTLFSDPELAISEEGALKMISLQRWLTLIFASSPYVNADHILNKYNINPDSEGGFHLATDNSSIAKFCIFYLPESNINMSLDALWAGNQQLCASLCFALQSSRFIGTASAFHKRAVVLQWFPKKLAEIADLNELPANILHDVYMHCSYDLAKNKHDVKRPLNELVRKHILTQGWQDRYLYTLGKKDGKPVMMVLLEHFNSGHSIYRTHSTSMIAAREKFYLVGLGSESVDEIGREVFDEFFEISSNNIMERLFFIRKQCETFQPAVFYMPSIGMDITTIFVSNTRLAPIQAVALGHPATTHSEFIDYVIVEDDYVGSEDCFSETLLRLPKDALPYVPSALAPQKVDYVLRENPEVVNIGIAATTMKLNPEFLVTLQEIRDKAKVKIHFHFALGQSTGLTHPYVKWFIESYLGDDATAHPHAPYHDYLAILRDCDMLLNPFPFGNTNGIIDMVTLGLVGVCKTGDEVHEHIDEGLFKRLGLPEWLIADTRETYIECALRLAENHQERLELRRYIIENNGLQKLFTGDPRPLGKILLKKTNEWKRKHLSKK

SEQ ID NO: 276 - protein, 545 aa, Haemophilus influenzae
MKNIKSRLKLSAISVLLGLASSSLYAEEAFLVKGFQLSGALETLSEDAQLSVAKSLSKYQGTQTLTNLKTAQLELQAVLDKIEPNKFDVILPQQTITDGNIMFELVSKSAAESQVFYKASQGYSEENIARSLPSLKQGKVYEDGRQWFDLREFNMAKENPLKVTRVHYELNPKNKTSNLIIAGFSPFGKTRSFISYDNFGAREFNYQRVSLGFVNANLTGHDDVLNLNALTNVKAPSKSYAVGVGYTYPFYSKHQSLSLYTSMSYADSNDIDGLPSAINRKLSKGQSISANLKWSYYLPTFNLGMEDQFKINLGYNYRHINQTSELNTLGATKKKFAVSGVSAGIDGHIQFTPKTIFNIDLTHHYYASKLPGSFGMERIGETFNRSYHISTASLGLSQEFAQGWHFSSQLSGQSTLQDISSIDLFSVTGTYGVRGFKYGGASGERGLVWRNELSMPKYTRFQISPYAFYDAGQFRYNSENAKIYGEDMHTVSSAGLGIKTSPTQNLSLDAFVARRFANANSDNLNGNKKRTSSPTTFWGRLTFSF

SEQ ID NO: 277 - protein, 1542 aa, Haemophilus influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQENNNSAVFNRVTSDQISQLKGILDSNGQVFLINPNGITIGKEAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAATIRNKGKLSADSVSKDKSGNIILSAKEGEAEISGVISAQNQQAKGGKLMITGDKVTLKTGAVIDLSGKEGGETYLGGDERGEGKNGIQLAKKTSLEKGSTINVSGKEKGGRAIVWGDIALIDGNINAQGSDIAKTGGFVETSGHYLSIDSNAIVKTKEWLLDPDNVTIEAPSLSRADTDISSEFPIGDGTENSPKKNADKTILTNETISNFLQNAKVMNITAKRKLTVNSSISIGSRSHLILHSEGQGDGGVQIDGDITSEGGNLTINSGGWVDVHKNITLGTGFLNITAGGSVAFEKGGNNARNATDAQITAQGTITVNKDDKQFRFNNVSINGTGEGLKFIANQNNFTHKFDGEINISGIVTINQTTKKDAKYWHASKDSYWNVSSLTLNDDAKFTFIKFVDSGSNSQDLRSARRRFAGVHFNGTGGKTNFNIGANAKALFKLKPNAATDPKKELPITFNANITATGSSDSSVMFDIHANLTSRAASINMDSINITGGLDFSITSHNRNSNAFEIKKDLTINATNSKFSLKQTKDLFENQYTGDAINSTRNLTILGGNVTLGGENSSSNITGNITIAAEANVTLQAYADNSIKGHKKKTLTLGNVSTSGNLSLTGSKVEVKGDLAVLNGATFKGETNDSLNITGTFTNNGTADINIKRGVVNIQGDITNKGGLNITTNAQKNQKTIINGNITNKKGNLNITNNGNDTEIQIGGNISQKEGNLTISSDKVNITKQITIKAGVDEKDSSSSTASDANLTIKTKELKLVEDLNISGFNKAEITAKDGSDLTIGNTNSADGTNAKKVTFNQVKDSKISANDHNVTLNSKVETSGNTDNTGDGSGNNAGLTIAAKNVEVKNNITSNKTVNITASEKLTTKADATINATTGNVEVTAKTGDIKGEVKSTSGNVNITANGDTLNVSNVSGNAVTITADKGKLTTQESSTISGTESVTTSSQSGDIGGAISGNTVSVKATNDLITKANSKIEAKTGEANVTSATGIIGGTISGNTVNVTANTGSLTIKGGAKVDATNGAATLTAESGKLTTQAGSTITSNNGQTTLTAKDGSIAGSIDAANVTLNTTGTLTTVVGSSINANEGTLVINAQDATLNGDASGDRTEVNAVNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 278 - protein, 446 aa, Haemophilus influenzae
MSNLNFDFAENDFRPLAAKMRPTNLEQYFGQSHLIGEGKPLRKAIQAGHIHSMILWGPPGTGKTTLAEIIAQRINAEVERISAVTSGIKEIREAIDRAKQNRLADRKTILFVDEVHRFNKSQQDAFLPHIEDGTVIFIGATTENPSFELNNALLSRARVYVLKSLTTAEIEQVLQQAVEDPERGLGKERLILEENLLQVLAEYVNGDARLALNCLELMVDMADEMENGKKIDRTLLKEVLGERQARFDKQGDRFYDLISALHKSVRGSAPDAALYWYARILTAGGDPLYVARRLLAIASEDVGNADPRAMQVALAAWDCFTRVGAYEGERAIAQAIIYLAVAPKSNAVYTAFNTAKQQAKDLPDYDVPPHLRNAPTNLMKELGYGAEYRYAHDEPNAYAAGENYFPPELKDTQYYFPTNRGMEIQIKEKLERLREQDKSTVKKRYK

SEQ ID NO: 279 - protein, 323 aa, Haemophilus influenzae
MENPPLVSVIVCAYNAEQYIDESISSIINQSYKNLEIIVINDGSTDLTLSHLEEISKLDKRIKIISNKYNLGFINSLNIGLGCFSGKYFARMDADDIAKPSWIEKIVTYLEKNDHITAMGSYLEIIVEKECGIIGSKYKTGDIWKNPLLHNDICEAMLFYNPIHNNTMIMRANVYREHKLIFNKDYPYAEDYKFWSEVSRLGCLANYPEALVKYRLHGNQTSSVYNHKQNEVAKKIKGENITYYLNKIGIDIKVINSVSLLEIYHVDKSNKVLKSILYDMYMSLDKYTITSLLHFIKYHLKLFDLKQNFKIIKKFIRKINVMF

SEQ ID NO: 280 - protein, 260 aa, Haemophilus influenzae
MSVELMTKAFKSKTGNPLTKLVLVKLADNANDDGVCYPSYKRIAIQCEVSRPTAISHVKKLEAMKYLSIRERKTENGNATNVYILHPENWEILEPFTSKAALPPLVNELNHPSKAALPPLVNELNPEPSIEPSDNHHIKKTTQKSESEMLLEQFGITGQLAKDFIAHRKAKKGVINQTQLNRLQKQADKAGISICEAVEICIERNWQGFNASWDWRDEKLRPNLPHLGQSHPNKPKFDDTQTGWSAGMNFTVDGTQWQIP

SEQ ID NO: 281 - protein, 805 aa, Haemophilus influenzae
MNAIRELVTLLRYKVDNSGLKAYVVQTQQAAKGIRSNLNNAVDGLRAKFSEAAVSAKGVGNNLKDAKNQILSLRNFVAGYFAMIAGGNVIKIADDWAAVDSRVKLATKSAEEHKYALSQIFDLSQRSGQDYLASADLFSKVNRSAGDLGLSLDDTLNLTEIIGQTMTIGGGDQGAQQAALMQLGQALGSGALRGDELNSIIEQAPRLANAIADSFGVPIGQLKDLGKEGKLTSKELAQGLLKQADKIQKEFDQMPKTFGRGMTILKNKAGQLIDVAVNKVSKLGAAFYNAAEWVTENIRLVGFLAGTVIGGKLMFALAASKKSLRQLLMMGARAVAPYLAMAAAAGVVALVLEDIYGWTQGDLSFTGALVGRYEVWADKFAALGKLADKLWINVRGLLKDLSRMAGVEINFDSWQAFATDVLEYIIAAVRNLINTVSGMVRIIRALINGDYAGAWSSAGDMIDGLSLKFLPLYSVGLMVLGGILSAVWALFSPFRAFFGLLKGGFRSVMFVAKPFIKVAKGIASPFIWAQKHFKLFSRVGSGAFSLLKRGAVKFTVYGLKAFKWLAIKGINGFFGILRAAVKFGVIFKSVVGTVVKGIFAIGRAMFMAVASNPILLAISAVIGLVILLVVYWDEVKAFAIAAWEAISTKAAEIWQSIITGASEMWDNITNKAAESWDNVKKDAGEKWNSVTTMFKNAWQKSIDTVVGWFNSLIPSWIRDLFSDGAKAEVKLSGEALTTPVSGHVSPQRLGYGGRPIFAPNQNMTQTNNFNIQGSANPSGVANAVSDKLSRGSSTSFGMGAIEYAG

SEQ ID NO: 282 - protein, 782 aa, Haemophilus influenzae
MKLKLIDLFKRITWAKNGDLTDFSQTNYEAGWAHLGDDTPTVQDFNYVQQMNDKKDQWLFNQLKAVLEKANIEPTEENVNSLRDAILALSKGYSNPKSLTADTVNFIDEQGHTHEIAKATLQQQGIVQLTNDTGLESESLALTAKAGKKLAQQTTQLQLNVSQNYIQNSKKSSAVNSESEDNVATSKAAKTAYDKAVEAKTTAESKVGLRGNESIQGTKSFESKIIGFRGIGVADSQTYANANHLLNMGANDGDGWIEYKKSNRVIGTIRIRANGELSYNNQKIYHAGAKPQFNTDIEGKPNTLAGYGIGNFKVEQGQGDANGYKTDGNYYVANGQNLPENGAWHIEVVSGGATNAVRQIARKANDNKIKTRFFNGSNWSEWKDAGGDGVPIGAVVSFPRAVTNPVGFLKADGSTFNQQSFPDLYRTLGDSNQLPDLTRSDVGMTAYFAVDNIPAGWIAFDSIRTTVTQQNYPELYRYLVGKYGSISNVPLAEDRFIRNASNNLSVGETQSDEIKKHVHKVRTHWVNSSDSNIFYDKTKTVIDSRLRTATTTDDNLSDNGFMHPLLDSPMATGGAETRPRAIALKLCIKAKNTFDDVQFWVKAFGVVENAGALDAGTLAQNMQALSERVEQKIEENKQSTLREITNAKADINQQFLQAQGNLSQIGTLKTVWQGNVGSGQITISEKCFGKTLILYLQSSVNHSLDDNNDIELVSFEVGAEIEGKKGGRVRWLDVREVNAHSNGGRPIYYVEVKRFDVTVDRDGTTIQIQNLAGRFVKRIDIR

SEQ ID NO: 283 - protein, 184 aa, Haemophilus influenzae
MKLTKTLLTTALFGASVFSFQSTAWADTLEQQFQQGLTAYEQSNYQTAFKLWLPMAEQGYAKAQFNLGVMYAKGQGVKQDDFEAVKWFRKAAEQGYAEAKFNLGHMYSKGRGVKQDDFEAVNWYRKAAEQGDADAQAILGFLYLLGERGVQVNKSLAKEWFGKACDNGNQNGCEYYGKLNRGEL

SEQ ID NO: 284 - protein, 615 aa, Haemophilus influenzae
MFRVLKFCWKVLCFIRDLVMNVVFLGFVLLLVAIISFSSGGKKSTALTSEGALLLNLDGYLADNRDETLRWQDALSELNGEHVPRKISTFDVVFAIQQAEDDPKIKGLVLDLNYFEGADLPALDFIGGAISHFKDAGKPVIAYADNYSQGQYYLASFADEIYLNSIGSVDIHGLSQENLYFKEMLDKLAVTPHIFRVGTYKSAVEPFLRNDMSAEAKANMQRWLGEMWNNYVLSVSENRNIKKDRILPNAKQYLAELKALKGNSTAYAQQRGLVTDVVTRLDLDKKFTALFGKGSDGKANLIEFDDYLTQLPDRLEHYNVPNKIAVVNVEGTIIDGESDEENAGGDTIARILRKAHDDNSVKAVILRVNSPGGSAFASEIIRQETENLQKIGKPVIVSMGAMAASGGYWISSTADYIIADANTITGSIGIFTMFPTFENSIKKIGVHADGVSTTELANTSAFSPLAKPVQDIYQTEIEHGYDRFLEIVSKGRQLSKTQVDKLAQGQVWLGSDAFQNGLVDEIGSFNEAVNKAEQLVNQRQDTAVQDFSVEWFTDDNVSLISTLLRDTKKGTQEQLVKWLGLPAPIQKLQKELNVLTKFNDPKGQYLYCLNCGKVQ

SEQ ID NO: 285 - protein, 571 aa, Haemophilus influenzae
MHLRSEGAMRDLFGYLPKSDLQRTAAIMADLLKQPKNQILSALKKGSKLDAYGLIDRDYRPDSVHDYLDWGETLDFDEFVTQPLNENVLLKSCTEVAQVPSLQLDDFDHIAGMKEMMLTYLQQALKHHRKGVNLLIYGVPGTGKTEFAGLLAQALGISAYNITYMDSDGDVVEAEQRLNYSRLAQTLLNGKQALLIFDEIEDVFNGSFMERSVAQKNKAWTNQLLENNNVPMIWLSNSVSGIDPAFLRRFDFILEMPDLPLKNKSALITQLTEGKLSPAYVQHFAKVRSLTPAILSRTIRVAKELNTSNFAETLLMMFNQTLKSQNKPKIEPLVLGKADYNLDYVACNDNIHRISEGLKRSKKGRICCYGPPGTGKTAWAAWLAEQLDMPLLLRQGSDLLNPYVGGTEQNIAQAFEQAKADNAILVLDEVDTFLFSREGANRSWERSQVNEMLTQIERFEGLMVVSTNLIEVLDHAALRRFDLKLKFDYLTLKQRLDFAKQQAEILGLPLLSEEDLSQIESLNLLTPGDFAAVARRHQFSPFHKVQDWLMALQGECEVKPAFSATTRRIGF

SEQ ID NO: 286 - protein, 191 aa, Haemophilus influenzae
MEKIMKKLTLALVLGSALAVTGCFDKQEAKQKVEDTKQTVASVASETKDAAANTMTEVKEKAQQLSTDVKNKVAEKVEDAKEVIKSATETASEKATEIKEAVSEKASEMKEAASEKASEMKEAASEKASEMKEAASEKASEMKEAASEKASEMKEAASEKVGEMKEKATEMKEAVSEKATQAVDAVKEATK

SEQ ID NO: 287 - protein, 397 aa, Haemophilus influenzae
MSDTLLNPYFGEFGGMYVPEILVPVLKQLEQAFVEAQNDPTFQAEFADLLKNYAGRPTALTLCRNLTKCTKTKLYLKREDLLHGGAHKTNQVLGQILLAKRMGKTRIIAETGAGQHGVATALACAMLDMPCRVYMGAKDVERQSPNVFRMRLMGAEVIPVEKGSCSLKDACCEAMRDWSANYETTHYLLGTAAGPHPFPTIVREFQKMIGEETKRQILEREGRLPDAVIAAVGGGSNAIGMFTDFIDEPNVRLIGVEPAGKGIESGEHGAPLGHAKVGIYFGMKSPLMQTEDGQVEESYSVSAGLDFPSVGPQHAYLNEIGRADYVSITDEEALNAFQELAKHEGIIPALESSHALAYALKLIKQNPEKEQLLVVNLSGRGDKDIFTVDKILNGGTN

SEQ ID NO: 288 - protein, 278 aa, Haemophilus influenzae
MKKTLITGLLVLAGTAQAHEVWVQAPTKLTSGSVLKAELAYGDYPYVEKIPEARLKIFAPMEIIRQDGEKQTLIQKGENYQYQSEKALSDGSYWVTATYKPTFWSQNAEGWKMDNLKELENPTYCEQTQMFGKSLVTVGKKPLNAEMAMTRVGLPLEIVPLRDPSKAKSGEPFPVQIFYQDQPLAGETVIATADTIIVKDLEASTGHREPQGFSGKTDSQGRVNIIPLIDGIWKIKVIHKTPFADQQICQQSASYSTLILPVGKGLAKLPPKPEHHHH

SEQ ID NO: 289 - protein, 274 aa, Haemophilus influenzae
MTKKYDLHCHSTASDGVLSPTELVHRAYAQGVNVLALCDHDTIVGIDEAEITAKEVGIELITGVEISTNWEGRGIHIVGLNFDKTHPKMTALLQSQKALREKRAVEIGDKLEKAGIPHAYDGAKALADGEVTRAHYARYLVQIGKVSNDGQAFKRYLGQGKSAFVKAEWADIPTAIETIHAAGGIAIIAHPLRYNMTGKWVRKLIVDFKAWGGDGMEMADCGQTKDQRQMLARWAKEFNLLGSVGSDFHFPCGWIELGKNLDLVDSVIPVWEKF

SEQ ID NO: 290 - protein, 954 aa, Haemophilus influenzae
MTQKFEMADRFNPSAVEQALYQHWEESGYFKPSENENAPSYCIAIPPPNVTGSLHMGHAFQQTLMDTLIRFNRMEGHNTLWQAGTDHAGIATQMVVERKIAAEEGKTRHDYGREAFINKIWDWKAYSGGTISQQMRRLGNSIDWERERFTMDDGLSNAVKEVFVRLHEEGLIYRGKRLVNWDPKLHTAISDLEVENKESKGSLWHFRYPLANGAKTADGKDYLVVATTRPETMLGDTAVAVHPEDERYQSLIGKTVVLPLANREIPIIADEYVDREFGTGVVKITPAHDFNDYEVGKRHNLPMVNVLTLNANIRDEAEIIGTDGKPLAGYEATIPADYRGLERFAARKKIVADFEALGLLDEIKPHDLKVPYGDRGGVPIEPMLTDQWYVSVKPLADVAIKAVEDGEIQFVPKQYENLYFSWMRDIQDWCISRQLWWGHRIPAWYDAEGNVYVARNEEEVRSKYNLDSAVELKQDEDVLDTWFSSGLWTFSTLGWPEQTKELKMFHPTDVLITGFDIIFFWVARMIMFTMHFVKDENGKPQVPFKTVYVTGLIRDEQGQKMSKSKGNVLDPIDMIDGISLEDLLEKRTGNMMQPQLAEKIAKATRKEFADGIAAHGTDALRFTLAALASNGRDINWDMKRLEGYRNFCNKLWNASRFVLTNEKLDLSEGEIEFSLADRWIQSEFNRTVETFRNSLSQYRFDLCANAIYEFTWNQFCDWYLELTKPVFANGNAAQIRAASQTLVHVLEKLLRLAHPLIPFITEEIWQKVKGFVGITADSIMLQPFPQVEENGFDLEAEAEIEWLKEVIVAVRNIRAESNIAPSKGLDLLFRNLSAENAKILEKQTALLKAMAKLDNVQVLAANEAAPLAVAKLVGNAELLVPMAGFINKEAELARLTKEIEKYQNEVKRIENKLSNESFVAKAPEAVIAKEREKQAEYQSGLEKIQEQYKAIEAL

SEQ ID NO: 291 - protein, 339 aa, Haemophilus influenzae
MFMHKMKKNLIIVLTLGTLPFAQANSITGAGASFPYPIYAKWASLYEKETGNKVNYQSIGSGGGQQQIIAKTVDFGASDDPMKSELLQQHQLVQFPAVIGGIVPVVNLPEIKPGKLKLSGKLLAEIFLGKIKKWNDPDLVALNPTLPLPNKNIIVIHRSDGSGTTFGFTNYLSKVSNDWKNQVGEGKSVKWLTGQGGKGNEGVASYVRQMKYSIGYVEYAYAKQNQLAWISLQNQAGQFVQPSNESFMAAASHAKWHEKAGMGVILTNETGEKSWPITAASFILLNKYSDNPETTKNVLAFFDWAFSRGQDAATELDYVPIPADVVSTIKSQWKTELKQ

SEQ ID NO: 292 - protein, 1510 aa, Haemophilus influenzae
MSDVFELENEIELESDEVIMENENVEEIVDAPMPFSMTTNNGVERGKFRSLTLINWNGFFARTFDLDELVTTLSGGNGAGKSTTMAGFVTALIPDLTLLHFRNTTEAGSTGGSRDKGLHGKLRPGVCYAVLDTINSRHQRILVGVRLQQIAGRDKKVDLKTFSIQGVELSQNPTALFTETVGERQARVLNLNELKDKIENIGAQFKQYHSITDYHGMMFDLGIIPKRLRSASDRSKFYKLIEASLYGGISSAITRSLRDYLLPENLGVRKAFQDMESALRENRMTLEAIKVTQSDRNLFKHLITETTNYVASDYMRNANERRGNIEAALESRREWYKAKAEQNLSQHRLVDLSREAAELAENERTLEVDHQSAVDHLNLVLNALRHQEKITRYQEDIAELTERLEEQKIVVEDANDALEESQAQFEQTEIEIDAVRAQLADYQQALDAQQTRALQYQQAITALEKAKTLCGLADLSVKNVEDYHAEFEAHAESLTETVLELEHKMSISEAAKSQFDKAYQLVCKIAGEIPRSSAWESAKELLREYPSQKLQAQQTPQLRTKLHELEQRYAQQQSAVKLLNDFNQRANLSLQTAEELEDYHAEQEALIEDISARLSEQVENRSTLRQKRENLTALYDENARKAPAWLTAQAALERLEQQSGETFEHSQDVMNFMQSQLVKERELTMQRDQLEQKRLQLDEQISRLSQPDGSEDPRLNMLAERFGGVLLSELYDDVTIEDAPYFSALYGPARHAIVVRDLNAVREQLAQLEDCPDDLYLIEGDPTAFDDSVLSAQELELGVVVQVSDRELRYSRFPEIPLFGRAAREKRLEELQIERDEVAEQYAQIAFDVQKCQRLHEHFSQFVGLHLALAFQPNPEELMSEINRERNEIDRELNQFNNGEQQLRIQLDNAKEKLQLLNKLIPQLNVLTDEDLIDRIEECREQLDIAEQDEYFIRQYGVTLSQLEPIANSLQSDPENYDGLKNELTQAIERQKQVQQRVFALADVVQRKHHFGYEDAGQAKTSELNEKLRQRLEQMQAQRDMQREQVRQKQSQFAEYNRVLIQLQSSYDSKYQLLNELISEISDLGVRADDGAEERARIRRDELHQQLSTSRQRRSYVEKQLTLIESEADNLNRLIRKTERDYKTQRELVVAAKVSWCVVLRLSRNSDMEKRLNRRELAYLSADELRSMSDKALGALRTAVADNEYLRDSLRVSEDSRKPENKVRFFIAVYQHLRERIRQDIIKTDDPIDAIEQMEIELSRLTAELTGREKKLAISSESVANIMRKTIQREQNRIRMLNQGLQNISFGQVKSVRLVVNIRDTHAMLLDALSGQQDEYQDLFNDNCITFSEAMAKLYQRINPHIDMGQRTAQTIGEELLDYRNYLELEVEVFRGADGWLRAESGALSTGEAIGTGMSILLMVVQSWEEESRRIRGKDIVPCRLLFLDEAARLDGKSISTLFELCERLDMQLLIAAPENISPEKGTTYKLVRKIAGNQEHVHVVGLRGFGATE

SEQ ID NO: 293 - protein, 730 aa, Haemophilus influenzae
MTTAVTQATIDGFFDASNGDPFATLGMHETEQGIEIRTLLPDANRMVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHPKSGVWELFLPKASLGQLYKFELIDCYGNLRLKADPYAFSSQLRPDTASQISALPNVVEMTEQRRQANQANQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRMDAVASMIYRDYSRAEGEWIPNQYGGRENLEAIEFLKHTNWKIHSEMAGAISIAEESTSFAGVTHPSEDGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFAFERRSSNGERIIVVSNFTPVPRHNYRIGVNVAGKYEEILNTDSMYYEGSNVGNFGCVASEKIESHGRENSISVSIPPLATVYLRLKAK

SEQ ID NO: 294 - protein, 557 aa, Haemophilus influenzae
MMSHTETSLGAENTRTHNFITQIIDEDLASGKHKSVHTRFPPEPNGYLHIGHAKSICLNFGLAKEYQGLCNLRFDDTNPVKEDVEYVDSIKADVEWLGFKWEGEPRYASDYFDALYGYAAELIKKGLAYVDELSPDEMREYRGTLTEPGKNSPYRDRTIEENLALFEKMKNGEFAEGKASLRAKIDMASPFMVMRDPVIYRIKFASHHQTGDKWCIYPMYDFTHCISDAIERITHSICTLEFQDNRRLYDWVLENISIERPLPHQYEFSRLNLEGTLTSKRKLLKLVNDEIVDGWNDPRMPTISGLRRRGYTPASLREFCRRIGVTKQDNVVEYSALEACIREDLNENAPRAMAVIDPVRVVIENFESEAVLTAPNHPNRPELGERQLPFTKELYIDRADFREEANKQYKRLVLGKEVRLRNAYVIKAERVEKDANGEITTIFCTYDPETLGKNPADGRKVKGVIHWVSAVNNHPAEFRLYDRLFTVPNPGAEDDIESVLNPNSLVIKQGFVEQSLANAEAEKGYQFEREGYFCADSKDSRPEHLVFNLTVSLKEGF

SEQ ID NO: 295 - protein, 292 aa, Haemophilus influenzae
MQELIKRTLPQDDALNQAIVNELRSQNWAGFLNYSQVQQLCHNFELTPLKLAMHLLPLAASYSHTAISHFNVGAIAIGEQGDFYFGANQEFANSAIQQTIHAEQSAISHAWLRNERRISDMVVNYTPCGHCRQFMNELHGAEKISIHLPHSQNNPLHSYLPDAFGPKDLDIAAHLLAEENHDLVADHQDDLVNQAILAANQSHCPYSNSPHGIAILFKNGDVVTGRYAENAAFNPSLPALQTALNFAYLNDKKLSDIERIVMAEKALKLSHKTMAETLLSTLTSVELEYYSL

SEQ ID NO: 296 - protein, 461 aa, Haemophilus influenzae
MQKNEIKQSDMKPLIIDSSWTERFLPDPPREKDNRPPFRRDRGRILHSAAFRCLQAKTQIHAIGENDFYRTRLTHSLEVAQIGSSLVAQLKFLETFESLSQTLNIDKNELQKQLKPLLPSNDLIESLCFAHDIGHPPFGHGGETALNYMMAEQGGFEGNAQTFRILTKLEPYTENAGMNLTRRTLLGVVKYPALLGVASPQYAELNFSRNIDPRFVRIHDWIPGKGIFRDDLKMFNWLLENLSENDRTLFCQFKKVRENPAESLHTRFKSLDCSIMELADDIAYGVHDLEDAIVTGVVNPHQWQAAHVALKQIPSAWLHENIDSISQRLFSDKHFERKQAIGALVNFFITNVRWKLTANFDEPLLRYNAELPPEVIAALGVFKKFVWDYVIRNVDTQRIEYKGQRMLTEMFQIFESDPERLLPRNTENRWRNAPKEGKKRIICDYIAGMSDAHALRVYQQL

SEQ ID NO: 297 - protein, 556 aa, Haemophilus influenzae
MQARRDTKIVDENHTLQQAFLNDLDEKLWSSADKLRQQLDAANYKHIVLGLIFLKYISDNFTHQQEKIQAELSDAENPLYLDRTFFDTEEEYQEALTAELENRDYYTADNVFWVPASARWQALQEVSILNTGAELPWGGKFSGVAKLIDDAFDAIEKDNEKLKGVLQRISGYAVNEDTLRGLIILFSDTNFTRPTYNGEPVHLGAKDILGHVYEYFLGRFAQAEGKRGGQYFTPKSIVSLIVEMLEPYSGRVYDPAMGSGGFFVQTERFITAHQGNINNVSIYGQEFNPTTWKLAAMNMAIRGIDYDFGKHNADSFTQPQHIDKKMDFIMANPPFNISDWWSESLADDPRWAYGTPPKGNANFAWLQHMIYHLSPNGKMALLLANGSMSSQTNNEGEIRKAIINADLVECMVALPGQLFTNTQIPACIWFLNRNKKRKGEVLFIDARQIGYMKDRVLRDFTADDIAKIADTLHTWQKSDGYEDQAAFCKSATLEEIKDNDFVLTPGRYVGTAEQEDDGVPFAEKMQNLTALLKEQFAKSAELEAEIKKNLGGLGYE

SEQ ID NO: 298 - protein, 254 aa, Haemophilus influenzae
MGWGGILGAMTQGLGTGIVKNVEQGWKDEETQKLLDWKTAEADKQRAFDSELLDKKYKHEFELEDHRTRNEISAAAAKARISARYSHGGESEAQKNLLGATQTLGIYDSQLHSLQEKLSATEDKEQQNAIAARINAVSAERENYLKRPDTIAAFKGAGQMGQALYMTGGGNMDLYNPKPVERETVAEDVKSSVAPPVRNMIDVNNLTPQQAADIARQKSEDAARLQFSKASADAKDWAQKRTQYQSSTFIPRTF

SEQ ID NO: 299 - protein, 840 aa, Haemophilus influenzae
MASQYFAILTDYGTRAIAHALSQGQPLQLTQFAVGDGNGKAVTPTANATALVHQTHIAPVSAVSLDPRNNKQVIVELTIPENIGGFYIREMGVFDAQNKLIAYANCPESFKPTESSGSGKVQVLRMILKVESSSAVTLSIDNSVIFVTRQQMTPKTITATTQNGFNESGHSHQIAKASTTQQGIVQLTNDTGLESESLALTAKAGKKLAQQTTQLQLNVSQNYIQNSKKSSAVNSESEDNVATSKAAKTAYDKAVEAKTTADGKVGLNGNESINGEKSFENRIVAKRNIRISDSQHYASRGDYLNIGANNGDCWFEYKSSNREIGTLRMHANGDLTYKRQKIYHAGAKPQFNTDIEGKPNTLAGYGIGNFKVEQGQGDANGYKTDGNYYLASGQNLPENGEWHIEVVSGGATNAVRQIARKANDNKIKTRFFNGSSWSEWKDAGGDGVPIGAVVSFPRAVTNPVGFLRADGSTFSQQTFPDLYRTLGNSNKLPDLTRSDVGMTAYFAVDNIPAGWIAFDEIATQVTEQRYPELYRHLVGKYGSISNVPLAEDRFIRNTGNGLNIGQTQSDEIKKHVHRVRTHWADSSDSSIFYDKTKTVIDSRLCTATTTDDNLSDNGFMHPLLDTPMATGGDETRPKSLILKLCIKAKNTFDDVQFWVKAFGVVENAGILDAGTLVQNMQALSARVDQEIKENKQSTLQEINNAKVDINQQFLQAQKNLSQIGTLKTVWQGNVSSGSINISEKCFGKTLILYLQSSSGHRLDDNNNIEIVSFEVGAEIEGKRGGGVYFSSIRQVIPHSSGGTSVYHVEVEEFAVTVDRNGTTIHIEELAGRFVKRIDIR

SEQ ID NO: 300 - protein, 349 aa, Haemophilus influenzae
MNKFTKQKFNTYLAGVAQDNGEDVAFIANGGQFTVEPTIQQKLENAVLESSDFLKRINVVMVQEMKGSALRLGVLSPVASRTDTNTKARETTDIHSLQENTYSCEQTNFDTHLNYPTLDSWAKFPDFAARVGKLKAERIALDRIMIGWNGTSAATTTNRTSNPLLQDVNKGWLVQIEDKAKARVLKEIEESSGKIEIGAGKTYKNLDALVFALKEDFIPAQYRDDTKLVAIMGSDLLADKYFPLINQEKPSEILAGDTVISQKRVGGLQAVSVPFFPKGTVLVTSLDNLSIYVQEGKVRRHLKDVPERNRVEDYLSSNEAYVVENYEAVAMAKNITILEAPTPISPVAA

SEQ ID NO: 301 - protein, 463 aa, Haemophilus influenzae
MKKTRFVLNSIALGLSVLSTSFVAQATLPSFVSEQNSLAPMLEKVQPAVVTLSVEGKAKVDSRSPFLDDIPEEFKFFFGDRFAEQFGGRGESKRNFRGLGSGVIINASKGYVLTNNHVIDGADKITVQLQDGREFKAKLVGKDEQSDIALVQLEKPSNLTEIKFADSDKLRVGDFTVAIGNPFGLGQTVTSGIVSALGRSTGSDSGTYENYIQTDAAVNRGNSGGALVNLNGELIGINTAIISPSGGNAGIAFAIPSNQASNLVQQILEFGQVRRGLLGIKGGELNADLAKAFNVSAQQGAFVSEVLPKSAAEKAGLKAGDIITAMNGQKISSFAEIRAKIATTGAGKEISLTYLRDGKSHDVKMKLQADDGSQLSSKTELPALDGATLKDYDAKGVKGIKITKIQPNSLAAQRGLKSGDIIIGINRQMIENIRELNKVLETEPSAVALNILRGDSNFYLLVQ

SEQ ID NO: 302 - protein, 322 aa, Haemophilus influenzae
MKKYKTGLVLLVIALALLVYFSPWFFLHIASWQKEFNQLISENLHQIQNNSIKAGITLIFVSFIYGVLHALGPGHGKFIIASYLSTHESQLKQSTILSLLSSLMQGIVAITATTLLVVVLNLSSRYFKLSQLWLERTALLLLVFLGCYWIWQGLRAYRKKAKLTIKSLNPLPLHEKSAVKNNRTFQPNTCSCGHQHLPSPTQTAQATNLKSQFLVILTIGMRPCSGAIFVLFLAYMLDLYSWGILAVLAMSFGTGLMLSAFAGIVRYARNTAIHLGHWYSSKNTKGKSESIVKLIAGGIMLFFALSLLYGTTISTGGSKILF

SEQ ID NO: 303 - protein, 220 aa, Haemophilus influenzae
MLLSILYIIGITAEGMTGALAAGREKMDIFGVIIIASVTAIGGGSVRDVLLGHYPLGWVKHPEYFLMVASAAVITVYVAPFINHFMRYFRTIFLVLDAMGLVVYSIIGAQIAMDMGHSLTIVCIAGCITGAFGGVLRDMLCNRIPLVFQKELYASIALFATLTYYALSTLQVEHTLAVLLTLISSFTLRLLAIHFEWGLPVFNYQELTSEEQDKLPNKKK

SEQ ID NO: 304 - protein, 635 aa, Haemophilus influenzae
MGKIIGIDLGTTNSCVAVMDGDKARVIENAEGARTTPSIIAYTDNETLVGQPAKRQAITNPKNTLFAIKRLIGRRFESEEVQRDIKIMPFEITRADNGDAWVNVKGDKLAPPQISAEVLKKMKKTAEDFLGESVTEAVITVPAYFNDAQRQATIDAGKIAGLDVKRIINEPTAAALAFGLGSSKENQVIAVYDLGGGTFDISIIEIDNFDGEQTFEVLATGGNTHLGGEDFDNRVIDYIIDEFKKEQNIDLRNDAMALQRVKEAAEKAKIELSSAQSTEVNLPYITADATGPKHLALNITRAKLEALVEDLVASSIESLKAVLKDADKGVSEIHDIILVGGQTRMPLVQQKVAEFFGKEARKDVNPDEAVAIGAAVQGGVLKGDVKDVLLLDVTPLSLGIETMGGVMTTLIEKNTTIPTKKSQVFSTAEDNQSAVTIHVLQGERKRAADNKSLGQFNLEGINPAPRGMPQIEVTFDIDANGVINVSAKDKNTGKEQQIRIQASSGLSDEEIQQMVRDAEANADADRKFEEVVQARNQADGIAHATRKQIAEAGDALSVADKEKIEAAVAELETAAKGEDKAEIEAKIEAVIKASEPLMQAVQAKAQQAGGEQPQQSSAKDDGVVDAEFEEVKDNK

SEQ ID NO: 305 - protein, 396 aa, Haemophilus influenzae
MIELLFLLLPIAAAYGWYMGRRSAKKDQDDISNKLSRDYVTGVNFLLSNQTDKAVDLFLDMLQKQEIENEIESHSQFEAELTLGNLFRSRGEVDRALRIHQALDLSPNYTFEQKLLAKQQLARDFMVVGFFDRAENLYILLVDEPEFAENALQQLLVIYQKTKEWKKAVNIAEKLAKIKPQENNIELAQCYCEYSQSLEPESAVEKRSVLQKALSVSPTCVRASLLLANLAMLDGQYQQAVEILENVLEQNPDYTGEILSPLKHCYEELNQLDNFELFLIRAGQIINNDEVELALVKLIEEKDGKSAAQAKLYQQLTKNPSTLIFHRFMQYQIDDAEDGRGKESLILLHKMVGERIKQTSPYRCTNCGYQIHKLLWNCPSCRQWESIKPVSNQEHN

SEQ ID NO: 306 - protein, 482 aa, Haemophilus influenzae
MLNQVSNTLLTPSNLSTQTLLNIFDIMSHRNIDYADLYFQLSQDESWVLEDGIIKEGGFHIDRGVGVRAVSGEKTGFAYADQINLASLQQCAEAVKGIAQVKQGNLISLSAFNVVNPIARYAAINPLESLTKEKKIELLHLVDRTARAEDHRVTKVSASLSSVYEEVLIMATDGTLAADIRPLVRLSISVLVEENGKRERGSCGSGGRFGLDWFFEVVDGDIRAVLFAKEAVRQALVNLSAVAAPAGLMPVVLGAGWPGVLLHEAVGHGLEGDFNRKESSLFTGKIGEQVTSPLCTIVDDGTIENRRGSLTIDDEGVPSQCNVLIKDGILQGYMQDKMNARLMGVAPTGNGRRESYAHLPMPRMTNTYMLAGQSQFDDLIASVKQGIYAPHFGGGQVDITSGKFVFSTSEAYLIEKGKITKPVKGATLIGSGIEVMQKISMVADKSELDLGIGVCGKEGQSVPVGVGQPALKIDEITVGGTN

SEQ ID NO: 307 - protein, 575 aa, Haemophilus influenzae
MSILLQGERFKKRLMPILLSMALAGCSNLLGSNFTQTLQKDANASSEFYINKLGQTQELEDQQTYKLLAARVLIRENKVEQSAALLRELGELNDAQKLDRALIEARISAAKNANEVAQNQLRALDLNKLSPSQKSRYYETLAIVAENRKDMIEAVKARIEMDKNLTDVQRRQDNIDKTWALLRSANTGVINNASDEGNAALGGWLTLIKAYNDYIRQPVQLSQALQSWKNAYPNHAAATLYPKELLTLLNFQQTNVSQIGLLLPLSGDGQILGTTIQSGFNDAKGNSTIPVQVFDTSMNSVQDIIAQAKQAGIKTLVGPLLKQNLDVILADPAQIQGMDVLALNATPHSRAIPQLCYYGLSPEDEAESAANKMWNDGVRNPLVAMPQNDLGQRVGNAFNVRWQQLAGTDANIRYYNLPADVTYFVQENNSNTTALYAVASPTELAEMKGYLTNIVPNLAIYASSRASASATNTNTDFIAQMNGVQFSDIPFFKDTNSPQYQKLAKSTGGEYQLMRLYAMGADAWLLINQFNELRQVPGYRLSGLTGILSADTNCNVERDMTWYQYQDGAIVPVAN

SEQ ID NO: 308 - protein, 950 aa, Haemophilus influenzae
MERKYCFKYHNKEVIMQQNKAFDDWLASTALGGANQSYIEELYESYLSDPQSVEESWRKTFDSLPKTTALEQPHTPVRDYFRRLARENHNEAVTVIDPAAGAKLVKVLQFINAYRFRGHLEANLDPLNYYRWKVSSVPELDYRHHGFTEQDLNETFNINHYVYKRDTIKLGELAQMLKETYCGSIGLEFMHVQDMEQKMWLQSKMESLLDKPLFTSEERVNFLRELTAADGLERYLGAKFPGAKRFSLEGSDAFIPLMKEIIRHSSRQGVNDVVMGMAHRGRLNMLVNVLGKKPENLFDEFAGKHSSERTGDVKYHQGFSSDFAVDDKRVHLTLAFNPSHLEIVSPVVIGSVRSRQTRMNDTEHSKVLAITVHGDSAVAGQGVVQETLNMSNARGYSVGGTIRIVINNQIGFTTSNPNDTRSTEYCTDIAKMIQAPIIHVNGDDPEAVAFTARMAVEYRNLFKRDIFIDLISYRRHGHNEADEPLATQPMMYSIIKKHPTPRKVYADRLVSEGVMTEEQVTEMANDYRDALDNGDRVVSEWREMDTAKMDWLQYLNYDWTAPYESKFSQERFLTLAKRVCEYPESLRAHPRVEKIYNDRKAMYQGEKLLDWGMAETMAYATLLDEGVNVRLSGEDAGRGTFFHRHAVVHNQNDGTGYVPLTHLHANQGRFEVWDSVLSEESVLAFEYGYATTDPKTLTIWEAQFGDFANGAQIVIDQFISSGEQKWGRMCGLVMLLPHGYEGQGPEHSSARLERYLQLCAEQNMQVCVPSTPAQVYHMLRRQSLRKMRRPLIAISPKSLLRHPLAVSSLDELINGTFQTVIGEIDELDPKDVKRVVMCSGKVYYDVLEQRRANNQKDVAIIRIEQLYPFPHEDVKKALEPYAHVTDYVWCQEEPLNQGAWYCSKHNFESAIPESVKLKYAGRPASASPAVGYMSLHTKQQKQLVEDALSF

SEQ ID NO: 309 - protein, 1492 aa, Haemophilus influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQESSNSAVFNRVTSDQISQLKGILDSNGQVFLINPNGITIGKDAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAANIRNQGKLSADSVSKDKSGNIVLSAKEGEAEIGGVISAQNQQAKGGKLMITGDKVTLKTGAVIDLSGKEGGETYLGGDERGEGKNGIQLAKKTSLEKGSTINVSGKEKGGRAIVWGDIALIDGNINAQGKDIAKTGGFVETSGHYLSIGNDAAVEAKEWLLDPDNVTISNGNDDQSQLKDDRGDSPNKILADNKHTVNNKTLSTALAKGIGVNISAKKKVNVTADINVHNGTLTLHSEQGGVEINGDITSEQNGNLTIKAGSWVDVHKNITIGMGFLNITAGGSVAFEKAGGDKGRAASDAKIVAQGVITAGSGQDFRFNNVSLNGTGRGLKFITAKGNKGNFSAKFDGVLNISGNISINHTANNQLSYFHRQGYTYWNLTQLNVDSDSSFSLTSIKDAIKVGGYDNAKDKKNTGGIGFTRDTIFNVKQGARVDISYTLPISPVKNSRIAAVNFDGNITVKGGGVVNLKFNALSNNYKTPGVNISSRFINVTEGSQLNITGSMPSTTLFNVANDLIINATNSFVSIKEIEGTDTHLDTGLKVNGNVTIKGGNVTLGSNKAKTKFDKNVTVEKGANLTLASANFGNHKGALTVAGNINTQGKLVATGDTIDVSGDFTVGNDATFNGNTNNNLNITGNFTNNGTSIIDVKKGAAKLGNITNEGSLNITTHANTNQKTIITGNITNKKGDLNIRDNKNNAEIQIGGNISQKEGNLTISSDKVNITKQITIKAGVNGENSDSGTENNANLTIKTKTLELTNNLNISGFHKAEITAKDNSDLIIGKASSDSGNAGAQKVIFDKVKDSKISAGNHNVTLNSEVETSNGNSNAAGDSNGNNAGLTISAKDVAVNNNITSHKTINISATTGNVTTKEGTTINATTGGVEVTAKTGDIKGGIESKSGGVTLTATGDTLAVGNISGNTVSVTANSGTLTTKADSTIKGTGSVTTLSQSGDIGGTISGKTVSVTATTDSLTVKGGAKINATEGTATLTASSGKLTTEASSSITSAKGQVDLSARDGNIGGSINAANVTLNTTGTLTTVKGSSINANSGTLVINAEDAKLDGTASGDRTVVNATNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 310 - protein, 207 aa, Haemophilus influenzae
MGTVKITSRYGILLGFIALLCTIISTGIFFLTKDKIDAVIAAQQRELLLQVIPQDYFNNNLLESAVIPQDKNFVGIQKIYFAKKDGNISAYAYETTAPDGYSGDIRLLVGLDPKGEVLGVRVIEHHETPGLGDKIERRISNWILGFTNQSINEHNLSEWAVKKDGGKFDQFSGATITPRAVVNQTKRSALIMLNNQALLQQLSTQVK

SEQ ID NO: 311 - protein, 659 aa, Haemophilus influenzae
MFQDNPLLAQLKQQIHDSKEQVEGVVKSTDKAYGFLECDKKTYFIAPPSMKKVMHGDKIKATIEKQGDKEQAEPEALIEPMLTRFIAKVRFNKDKKLQVLVDHPSINQPIGAQQAKSVKEELQEGDWVVANLKTHPLRDDRFFYATINQFICRADDELAPWWVTLARHEQSRYPVQGAEHYEMLDQKTRENLTALHFVTIDSESTMDMDDALYIEPIAQNSTQTGWKLVVAIADPTAYIALDSQIEQEAKQRCFTNYLPGFNIPMLPRELSDELCSLIANETRPALVCYIETDLAGNITAKPHFVSAYVQSKAKLAYNKVSDYLEQADNAWQPETPETAQQIHWLHQFTKARIQWHKTHSLLFKEKPDYAFVLAENGKVQEIKAEYRRIANQIVEEAMIIANICAAQFLHEQAKTGIFNTHSGFDKKFLENAHHFLMANLANEQNQTELAERYSVENLATLNGYCQMRHDIEPIESDYLELRLRRYLTFAEFKSELAPHFGLGLEGYATWTSPIRKYSDMVNHRLIKAVLAKQPYEKTQNDVLARLQEARRQNRLVERDIADWLYCRYLAPKVAENVEFNAEVQDVMRGGLRVQLLENGASMFIPASTLHNNKEEMQVNSDEIALYIKGERTYKIGDIVKVKLTEVKEATRSIVGEILQ

SEQ ID NO: 312 - protein, 309 aa, Haemophilus influenzae
MKPTFLEFRHLKTLLALKETGSVSLAAKHVYLTQSALSHQIKLIEEQFGLPLFERKSNPLRFTSAGERLIRLANEVMPKVIDAERDLARVKHGDAGQLRIAVECHTCFDWLMPAMDEFRQHWGLVELDIVSGFHTDPVGLLLSHRADWAIVSEIEHNDDVIFKPLFSYEMVGICSKNHSLAEKDIWEAEDFIDETWVTYPVPDDMLDLWRKVLKSKGINPTRRTTELTIAMIQLVASRRGIATIPYWAALPYLEKGYVVARKVTKEGLYSNLYAAIRKEDESLSYLEDFYQTVKSQSFSTLPGLSVLNL

SEQ ID NO: 313 - DNA, 19 bp, Artificial Sequence
  Gene-specific oligonucleotide primer
gcgtgatccgttacctatt

SEQ ID NO: 314 - DNA, 21 bp, Artificial Sequence
  Gene-specific oligonucleotide primer
gttgagcataattccaagtca

SEQ ID NO: 315 - DNA, 23 bp, Artificial Sequence
  Gene-specific oligonucleotide primer
gaaaaaactgaaaatttagaccg

SEQ ID NO: 316 - DNA, 17 bp, Artificial Sequence
  Gene-specific oligonucleotide primer
cgcaccttgtgtcgcac

SEQ ID NO: 317 - DNA, 27 bp, Artificial Sequence
  Gene-specific oligonucleotide primer
gattattttaatactgatagcatttgc

SEQ ID NO: 318 - DNA, 21 bp, Artificial Sequence
  Gene-specific oligonucleotide primer
gattttatttgcacctgcatc

SEQ ID NO: 319 - DNA, 21 bp, Artificial Sequence
  Gene-specific oligonucleotide primer
cgaacagctaacccaactttc

SEQ ID NO: 320 - DNA, 27 bp, Artificial Sequence
  Gene-specific oligonucleotide primer
ggtcatttttgtttcagttttattatc

SEQ ID NO: 321 - DNA, 21 bp, Artificial Sequence
  Gene-specific oligonucleotide primer
gcgaaaaaagcattaatgacg

SEQ ID NO: 322 - DNA, 23 bp, Artificial Sequence
  Gene-specific oligonucleotide primer
ggtacgcgatcgtagctataatc

SEQ ID NO: 323 - DNA, 28 bp, Artificial Sequence
  Gene-specific oligonucleotide primer
ctgatgaattacttaattactttttacc

SEQ ID NO: 324 - DNA, 20 bp, Artificial Sequence
  Gene-specific oligonucleotide primer
gattccaagcaaagagtgcc

SEQ ID NO: 325 - DNA, 19 bp, Artificial Sequence
  Gene-specific oligonucleotide primer
gtgcgggcagagagtctag

SEQ ID NO: 326 - DNA, 22 bp, Artificial Sequence
  Gene-specific oligonucleotide primer
catgagatgtccttatggtttg

SEQ ID NO: 327 - DNA, 28 bp, Artificial Sequence
  Gene-specific oligonucleotide primer
gacagtttttatactgtaagtggtttag

SEQ ID NO: 328 - DNA, 18 bp, Artificial Sequence
  Gene-specific oligonucleotide primer
gcaaaacaacatggcgag

SEQ ID NO: 329 - DNA, 22 bp, Artificial Sequence
  Gene-specific oligonucleotide primer
cttaggctttgatttttggttg

SEQ ID NO: 330 - DNA, 24 bp, Artificial Sequence
  Gene-specific oligonucleotide primer
gctatctaattcaggtggataacc

SEQ ID NO: 331 - DNA, 27 bp, Artificial Sequence
  Gene-specific oligonucleotide primer
gtgtagatgagtatttcaaagatgaac

SEQ ID NO: 332 - DNA, 32 bp, Artificial Sequence
  Gene-specific oligonucleotide primer
gataaatctttaaaagagatatctaaagtatc

SEQ ID NO: 333 - DNA, 21 bp, Artificial Sequence
  Gene-specific oligonucleotide primer
ctgatggctggatttcttttc

SEQ ID NO: 334 - DNA, 21 bp, Artificial Sequence
  Gene-specific oligonucleotide primer
ccatgtggatcagataaccag

SEQ ID NO: 335 - DNA, 19 bp, Artificial Sequence
  Gene-specific oligonucleotide primer
ccaggtgggctttttgttg

SEQ ID NO: 336 - DNA, 23 bp, Artificial Sequence
  Gene-specific oligonucleotide primer
gattaaaattcatcggtagccag

SEQ ID NO: 337 - DNA, 21 bp, Artificial Sequence
  Gene-specific oligonucleotide primer
gtttagccagtgaaattgctg

SEQ ID NO: 338 - DNA, 25 bp, Artificial Sequence
  Gene-specific oligonucleotide primer
gagctagtaataaatcctgaaccag

SEQ ID NO: 339 - DNA, 22 bp, Artificial Sequence
  Gene-specific oligonucleotide primer
gcggtagatctgaataatccac

SEQ ID NO: 340 - DNA, 21 bp, Artificial Sequence
  Gene-specific oligonucleotide primer
ctcaacaagaggcaattcaag

SEQ ID NO: 341 - DNA, 21 bp, Artificial Sequence
  Gene-specific oligonucleotide primer
ctatgaagcaggcgattgaag

SEQ ID NO: 342 - DNA, 26 bp, Artificial Sequence
  Gene-specific oligonucleotide primer
catctaaaatttcatcaaattcatcc

SEQ ID NO: 343 - DNA, 24 bp, Artificial Sequence
  Gene-specific oligonucleotide primer
cattaaatattaatggaatgggtg

SEQ ID NO: 344 - DNA, 21 bp, Artificial Sequence
  Gene-specific oligonucleotide primer
ggtatctgcagcattgcctac

SEQ ID NO: 345 - DNA, 21 bp, Artificial Sequence
  Gene-specific oligonucleotide primer
gtagctcgtcgggctcataac

SEQ ID NO: 346 - DNA, 23 bp, Artificial Sequence
  Gene-specific oligonucleotide primer
ggtggattacagataaccgtacc

SEQ ID NO: 347 - DNA, 19 bp, Artificial Sequence
  Gene-specific oligonucleotide primer
caatggcttcagtggcatc

SEQ ID NO: 348 - DNA, 24 bp, Artificial Sequence
  Gene-specific oligonucleotide primer
gtaattctcaaagggaaaaaagag

SEQ ID NO: 349 - DNA, 22 bp, Artificial Sequence
  Gene-specific oligonucleotide primer
cctcttgaaaatgcacattgac

SEQ ID NO: 350 - DNA, 25 bp, Artificial Sequence
  Gene-specific oligonucleotide primer
gctaaacattccatgtagctatctg

SEQ ID NO: 351 - DNA, 24 bp, Artificial Sequence
  Gene-specific oligonucleotide primer
gttcagtggcgttaattatagatc

SEQ ID NO: 352 - DNA, 22 bp, Artificial Sequence
  Gene-specific oligonucleotide primer
ccatcggtgatttaatatgtgg

SEQ ID NO: 353 - DNA, 25 bp, Artificial Sequence
  Gene-specific oligonucleotide primer
catttaaaaaagtgtgatcttgatg

SEQ ID NO: 354 - DNA, 29 bp, Artificial Sequence
  Gene-specific oligonucleotide primer
cttaaatagctaattgatttaaaaatctg

SEQ ID NO: 355 - DNA, 18 bp, Artificial Sequence
  Gene-specific oligonucleotide primer
gcatagtttgcgttcccc

SEQ ID NO: 356 - DNA, 18 bp, Artificial Sequence
  Gene-specific oligonucleotide primer
gcaccttcccccgtaaac

SEQ ID NO: 357 - DNA, 20 bp, Artificial Sequence
  Gene-specific oligonucleotide primer
cgcacttttatgaatggaat

SEQ ID NO: 358 - DNA, 22 bp, Artificial Sequence
  Gene-specific oligonucleotide primer
cagagccatctaaagtacgaat

SEQ ID NO: 359 - DNA, 25 bp, Artificial Sequence
  Gene-specific oligonucleotide primer
ggtattgatgaaaaattaggtatgc

SEQ ID NO: 360 - DNA, 25 bp, Artificial Sequence
  Gene-specific oligonucleotide primer
gcataaataaaataaaacgaatacc

SEQ ID NO: 361 - DNA, 20 bp, Artificial Sequence
  Gene-specific oligonucleotide primer
ctttagcaaaagtgcggttg

SEQ ID NO: 362 - DNA, 21 bp, Artificial Sequence
  Gene-specific oligonucleotide primer
ccgcattcttaactcatcttg

SEQ ID NO: 363 - DNA, 25 bp, Artificial Sequence
  Gene-specific oligonucleotide primer
gtattggaagatttagcaaaaattc

SEQ ID NO: 364 - DNA, 24 bp, Artificial Sequence
  Gene-specific oligonucleotide primer
ccaaaatatagcgttcaaaattag

SEQ ID NO: 365 - DNA, 25 bp, Artificial Sequence
  Gene-specific oligonucleotide primer
cactgttaaaaattatcgtcaattc

SEQ ID NO: 366 - DNA, 18 bp, Artificial Sequence
  Gene-specific oligonucleotide primer
caataccgctacccgcac

SEQ ID NO: 367 - DNA, 23 bp, Artificial Sequence
  Gene-specific oligonucleotide primer
cttcccattaaccgtaaactacc

SEQ ID NO: 368 - DNA, 22 bp, Artificial Sequence
  Gene-specific oligonucleotide primer
caatgatttgtgcatcacgttc

SEQ ID NO: 369 - DNA, 25 bp, Artificial Sequence
  Gene-specific oligonucleotide primer
gataatcaagagcagttatttgatg

SEQ ID NO: 370 - DNA, 26 bp, Artificial Sequence
  Gene-specific oligonucleotide primer
gcgaatattttctacatattgatagg

SEQ ID NO: 371 - DNA, 23 bp, Artificial Sequence
  Gene-specific oligonucleotide primer
ggaatgtagatagtggcttaacg

SEQ ID NO: 372 - DNA, 29 bp, Artificial Sequence
  Gene-specific oligonucleotide primer
gttaatcatactaaggataaaaatatgac

SEQ ID NO: 373 - DNA, 21 bp, Artificial Sequence
  Gene-specific oligonucleotide primer
ctttaacaaatcacagccaat

SEQ ID NO: 374 - DNA, 22 bp, Artificial Sequence
  Gene-specific oligonucleotide primer
ctaacgtgaatgtgagtttgtc

SEQ ID NO: 375 - DNA, 21 bp, Artificial Sequence
  Gene-specific oligonucleotide primer
ctttaaaaattgatgccgaag

SEQ ID NO: 376 - DNA, 29 bp, Artificial Sequence
  Gene-specific oligonucleotide primer
catagattgaaaagtaaatgataaaaatc

SEQ ID NO: 377 - DNA, 19 bp, Artificial Sequence
  Gene-specific oligonucleotide primer
caattccagtgaagtgggc

SEQ ID NO: 378 - DNA, 26 bp, Artificial Sequence
  Gene-specific oligonucleotide primer
gcgtgatttaaattctagttaataac

SEQ ID NO: 379 - DNA, 29 bp, Artificial Sequence
  Gene-specific oligonucleotide primer
caattaaatgcaaatgattataaataaac

SEQ ID NO: 380 - DNA, 23 bp, Artificial Sequence
  Gene-specific oligonucleotide primer
cactgactttacgctgttctttc

SEQ ID NO: 381 - DNA, 25 bp, Artificial Sequence
  Gene-specific oligonucleotide primer
gcaagtacagattttagatcgaaac

SEQ ID NO: 382 - DNA, 23 bp, Artificial Sequence
  Gene-specific oligonucleotide primer
gtaaaatttgctcgtgagacaag

SEQ ID NO: 383 - DNA, 21 bp, Artificial Sequence
  Gene-specific oligonucleotide primer
ctttaaaactgatggcgatac

SEQ ID NO: 384 - DNA, 22 bp, Artificial Sequence
  Gene-specific oligonucleotide primer
ttaaactgagtaaaccaaaagc

SEQ ID NO: 385 - DNA, 26 bp, Artificial Sequence
  Gene-specific oligonucleotide primer
gtcagaaagaacagattttattaatg

SEQ ID NO: 386 - DNA, 19 bp, Artificial Sequence
  Gene-specific oligonucleotide primer
gcgtaatccccattaaacg

SEQ ID NO: 387 - DNA, 19 bp, Artificial Sequence
  Gene-specific oligonucleotide primer
gttggcattccaaaccttg

SEQ ID NO: 388 - DNA, 20 bp, Artificial Sequence
  Gene-specific oligonucleotide primer
ggatattcatttgctgcacg

SEQ ID NO: 389 - DNA, 25 bp, Artificial Sequence
  Gene-specific oligonucleotide primer
caatatcgtgatgatggttacttac

SEQ ID NO: 390 - DNA, 23 bp, Artificial Sequence
  Gene-specific oligonucleotide primer
cttgctttattaatttggtggag

SEQ ID NO: 391 - DNA, 25 bp, Artificial Sequence
  Gene-specific oligonucleotide primer
ggtggaaatttaataaattcttgtg

SEQ ID NO: 392 - DNA, 26 bp, Artificial Sequence
  Gene-specific oligonucleotide primer
ctgcaacataatttgtaaactttgac

SEQ ID NO: 393 - DNA, 19 bp, Artificial Sequence
  Gene-specific oligonucleotide primer
cgagcgcaacaaaataaac

SEQ ID NO: 394 - DNA, 21 bp, Artificial Sequence
  Gene-specific oligonucleotide primer
gattgaagcagtcgttcaagc

SEQ ID NO: 395 - DNA, 21 bp, Artificial Sequence
  Gene-specific oligonucleotide primer
ccaagttctgacaccgttgag

SEQ ID NO: 396 - DNA, 23 bp, Artificial Sequence
  Gene-specific oligonucleotide primer
ctttttctacttgcattttttgc

SEQ ID NO: 397 - DNA, 22 bp, Artificial Sequence
  Gene-specific oligonucleotide primer
gtgttccccagttatcattcat

SEQ ID NO: 398 - DNA, 24 bp, Artificial Sequence
  Gene-specific oligonucleotide primer
catcaatttctacattaaaacgtg

SEQ ID NO: 399 - DNA, 19 bp, Artificial Sequence
  Gene-specific oligonucleotide primer
ctgggaaaatgcacgattc

SEQ ID NO: 400 - DNA, 22 bp, Artificial Sequence
  Gene-specific oligonucleotide primer
gaccaaattcagcgtattcttc

SEQ ID NO: 401 - DNA, 25 bp, Artificial Sequence
  Gene-specific oligonucleotide primer
caggtaatggaacaagtttaaaatc

SEQ ID NO: 402 - DNA, 26 bp, Artificial Sequence
  Gene-specific oligonucleotide primer
cattaggtaaacgtaatatatcccag

SEQ ID NO: 403 - DNA, 27 bp, Artificial Sequence
  Gene-specific oligonucleotide primer
caattatctagacaggaatttgataag

SEQ ID NO: 404 - DNA, 26 bp, Artificial Sequence
  Gene-specific oligonucleotide primer
cgttttaataatttcattttgttacc

SEQ ID NO: 405 - DNA, 24 bp, Artificial Sequence
  Gene-specific oligonucleotide primer
ccaacaaattaggataaaaaatgg

SEQ ID NO: 406 - DNA, 20 bp, Artificial Sequence
  Gene-specific oligonucleotide primer
ccagtgattgcttcaaaacg

SEQ ID NO: 407 - DNA, 23 bp, Artificial Sequence
  Gene-specific oligonucleotide primer
cggtcattttcttttccttatat

SEQ ID NO: 408 - DNA, 23 bp, Artificial Sequence
  Gene-specific oligonucleotide primer
tgctctttttcaaaatcaatatg

SEQ ID NO: 409 - DNA, 24 bp, Artificial Sequence
  Gene-specific oligonucleotide primer
cgagcgagtacaagtagataaaac

SEQ ID NO: 410 - DNA, 24 bp, Artificial Sequence
  Gene-specific oligonucleotide primer
cttgcctttaggtttttatctaag

SEQ ID NO: 411 - DNA, 23 bp, Artificial Sequence
  Gene-specific oligonucleotide primer
caacatatttgttgtgcaggtac

SEQ ID NO: 412 - DNA, 27 bp, Artificial Sequence
  Gene-specific oligonucleotide primer
gatttcatcagttaaatcaactttatc

SEQ ID NO: 413 - DNA, 27 bp, Artificial Sequence
  Gene-specific oligonucleotide primer
cgagattcaaaattctttaaatagtag

SEQ ID NO: 414 - DNA, 19 bp, Artificial Sequence
  Gene-specific oligonucleotide primer
cataatgtaaatgcggccc

SEQ ID NO: 415 - DNA, 23 bp, Artificial Sequence
  Gene-specific oligonucleotide primer
ggtttacctaaagcaccttcaac

SEQ ID NO: 416 - DNA, 23 bp, Artificial Sequence
  Gene-specific oligonucleotide primer
gcttcgctagcaaaatattgatc

SEQ ID NO: 417 - DNA, 24 bp, Artificial Sequence
  Gene-specific oligonucleotide primer
caaataacgatgattgaaggatag

SEQ ID NO: 418 - DNA, 17 bp, Artificial Sequence
  Gene-specific oligonucleotide primer
ccgcttcacttgccagc

SEQ ID NO: 419 - DNA, 24 bp, Artificial Sequence
  Gene-specific oligonucleotide primer
gaagtgaagaaatataatgcttcc

SEQ ID NO: 420 - DNA, 24 bp, Artificial Sequence
  Gene-specific oligonucleotide primer
gccgataataaagacttttttacc

SEQ ID NO: 421 - DNA, 22 bp, Artificial Sequence
  Gene-specific oligonucleotide primer
gaaaagggatttatacgctctc

SEQ ID NO: 422 - DNA, 24 bp, Artificial Sequence
  Gene-specific oligonucleotide primer
gattttcactgctataccaaattg

SEQ ID NO: 423 - DNA, 20 bp, Artificial Sequence
  Gene-specific oligonucleotide primer
gatttttgttgatcgtggcc

SEQ ID NO: 424 - DNA, 24 bp, Artificial Sequence
  Gene-specific oligonucleotide primer
cgcaattaaaaatttcttcataag

SEQ ID NO: 425 - DNA, 22 bp, Artificial Sequence
  Gene-specific oligonucleotide primer
catattattggtcaagccgatg

SEQ ID NO: 426 - DNA, 23 bp, Artificial Sequence
  Gene-specific oligonucleotide primer
ggctttatattgttcggttaaag

SEQ ID NO: 427 - DNA, 24 bp, Artificial Sequence
  Gene-specific oligonucleotide primer
gaaaatcgtggcattgtttatatc

SEQ ID NO: 428 - DNA, 28 bp, Artificial Sequence
  Gene-specific oligonucleotide primer
gcgtaaaatattcaaaatattatctacg

SEQ ID NO: 429 - DNA, 22 bp, Artificial Sequence
  Gene-specific oligonucleotide primer
cattacaaaaagcattgggtac

SEQ ID NO: 430 - DNA, 25 bp, Artificial Sequence
  Gene-specific oligonucleotide primer
caacaacatcttgtaaaaaagtttc

SEQ ID NO: 431 - DNA, 19 bp, Artificial Sequence
  Gene-specific oligonucleotide primer
gattgggcaaactttttgg

SEQ ID NO: 432 - DNA, 23 bp, Artificial Sequence
  Gene-specific oligonucleotide primer
ccatcttttactggcacattaag

SEQ ID NO: 433 - DNA, 20 bp, Artificial Sequence
  Gene-specific oligonucleotide primer
ctgattggattatgcacggt

SEQ ID NO: 434 - DNA, 25 bp, Artificial Sequence
  Gene-specific oligonucleotide primer
cgaatttatcttctaattcgatttc

SEQ ID NO: 435 - DNA, 26 bp, Artificial Sequence
  Gene-specific oligonucleotide primer
cgctacattaaagaactatatttcag

SEQ ID NO: 436 - DNA, 23 bp, Artificial Sequence
  Gene-specific oligonucleotide primer
gaatgatgtaattcgcttatacg

SEQ ID NO: 437 - DNA, 21 bp, Artificial Sequence
  Gene-specific oligonucleotide primer
gcttgagaaaaaaagtcgtcg

SEQ ID NO: 438 - DNA, 21 bp, Artificial Sequence
  Gene-specific oligonucleotide primer
cgtgagcgagcaaatctaatt

SEQ ID NO: 439 - DNA, 25 bp, Artificial Sequence
  Gene-specific oligonucleotide primer
gttcttctcactcagcaatgattag

SEQ ID NO: 440 - DNA, 23 bp, Artificial Sequence
  Gene-specific oligonucleotide primer
ggatttataatttgtttgccaag

SEQ ID NO: 441 - DNA, 22 bp, Artificial Sequence
  Gene-specific oligonucleotide primer
gtacaagaacatggaggcaaag

SEQ ID NO: 442 - DNA, 22 bp, Artificial Sequence
  Gene-specific oligonucleotide primer
ctttatttgggaataaacggtg

SEQ ID NO: 443 - DNA, 22 bp, Artificial Sequence
  Gene-specific oligonucleotide primer
cctgctgctatttcaattattc

SEQ ID NO: 444 - DNA, 20 bp, Artificial Sequence
  Gene-specific oligonucleotide primer
cttgcgtgcttcaacactac

SEQ ID NO: 445 - DNA, 25 bp, Artificial Sequence
  Gene-specific oligonucleotide primer
gctgaagcacttaagaaagaattag

SEQ ID NO: 446 - DNA, 27 bp, Artificial Sequence
  Gene-specific oligonucleotide primer
gaatagggttttatttctacatcattg

SEQ ID NO: 447 - DNA, 20 bp, Artificial Sequence
  Gene-specific oligonucleotide primer
gaaagaatggagctgattgc

SEQ ID NO: 448 - DNA, 21 bp, Artificial Sequence
  Gene-specific oligonucleotide primer
gtttgctatgatgaaaaaggc

SEQ ID NO: 449 - DNA, 26 bp, Artificial Sequence
  Gene-specific oligonucleotide primer
ccctacaattactaatatcaacaatc

SEQ ID NO: 450 - DNA, 24 bp, Artificial Sequence
  Gene-specific oligonucleotide primer
ctttaatattgtttgcttgttctc

SEQ ID NO: 451 - DNA, 23 bp, Artificial Sequence
  Gene-specific oligonucleotide primer
ctaatatcaacaatcaacggctc

SEQ ID NO: 452 - DNA, 26 bp, Artificial Sequence
  Gene-specific oligonucleotide primer
gtctttaatattgtttgcttgttctc

SEQ ID NO: 453 - DNA, 21 bp, Artificial Sequence
  Gene-specific oligonucleotide primer
gggcaacaggtgtatttactg

SEQ ID NO: 454 - DNA, 19 bp, Artificial Sequence
  Gene-specific oligonucleotide primer
cggtgaaaattaaccgcac

SEQ ID NO: 455 - DNA, 21 bp, Artificial Sequence
  Gene-specific oligonucleotide primer
gcattatgcaaccagtagaag

SEQ ID NO: 456 - DNA, 20 bp, Artificial Sequence
  Gene-specific oligonucleotide primer
gcggtaaaaatttgttgaga

SEQ ID NO: 457 - DNA, 23 bp, Artificial Sequence
  Gene-specific oligonucleotide primer
gtggaacaagtattgaaagatcc

SEQ ID NO: 458 - DNA, 21 bp, Artificial Sequence
  Gene-specific oligonucleotide primer
ctctcttagtgcatccgtttc

SEQ ID NO: 459 - DNA, 19 bp, Artificial Sequence
  Gene-specific oligonucleotide primer
caccgttagcccagaaatg

SEQ ID NO: 460 - DNA, 21 bp, Artificial Sequence
  Gene-specific oligonucleotide primer
gcactttcaatcgcatttaag

SEQ ID NO: 461 - DNA, 24 bp, Artificial Sequence
  Gene-specific oligonucleotide primer
gattcagtaagtaaacaggcttgg

SEQ ID NO: 462 - DNA, 24 bp, Artificial Sequence
  Gene-specific oligonucleotide primer
caaaaaaaatggaaaaaacatttc

SEQ ID NO: 463 - DNA, 22 bp, Artificial Sequence
  Gene-specific oligonucleotide primer
gcagcagctttagtgaagaaag

SEQ ID NO: 464 - DNA, 21 bp, Artificial Sequence
  Gene-specific oligonucleotide primer
ttaaacgacaacgaccaactg

SEQ ID NO: 465 - DNA, 21 bp, Artificial Sequence
  Gene-specific oligonucleotide primer
cgttctttctaaagcgtatgg

SEQ ID NO: 466 - DNA, 24 bp, Artificial Sequence
  Gene-specific oligonucleotide primer
caagcaattgaattacaatagatg

SEQ ID NO: 467 - DNA, 22 bp, Artificial Sequence
  Gene-specific oligonucleotide primer
ggtctaaagactcggatttgag

SEQ ID NO: 468 - DNA, 21 bp, Artificial Sequence
  Gene-specific oligonucleotide primer
gtctaatgctttgaacgcttg

SEQ ID NO: 469 - DNA, 23 bp, Artificial Sequence
  Gene-specific oligonucleotide primer
cgtcataatatggacgatttagc

SEQ ID NO: 470 - DNA, 21 bp, Artificial Sequence
  Gene-specific oligonucleotide primer
gtggagcgatgaatatccttg

SEQ ID NO: 471 - DNA, 23 bp, Artificial Sequence
  Gene-specific oligonucleotide primer
gttaattggtgaaccaggtgtag

SEQ ID NO: 472 - DNA, 24 bp, Artificial Sequence
  Gene-specific oligonucleotide primer
ggttcaggtttagaatctatttcc

SEQ ID NO: 473 - DNA, 19 bp, Artificial Sequence
  Gene-specific oligonucleotide primer
gcaaaggctggaaactttg

SEQ ID NO: 474 - DNA, 19 bp, Artificial Sequence
  Gene-specific oligonucleotide primer
catgatcttgcatatattc

SEQ ID NO: 475 - DNA, 22 bp, Artificial Sequence
  Gene-specific oligonucleotide primer
caatttaaacacggaagcaatg

SEQ ID NO: 476 - DNA, 22 bp, Artificial Sequence
  Gene-specific oligonucleotide primer
gtgcaattttgcacggtatatg

SEQ ID NO: 477 - DNA, 23 bp, Artificial Sequence
  Gene-specific oligonucleotide primer
gcacttttatctgaacaagatcg

SEQ ID NO: 478 - DNA, 22 bp, Artificial Sequence
  Gene-specific oligonucleotide primer
ctaaagtgcggtcaagttcttc

SEQ ID NO: 479 - DNA, 22 bp, Artificial Sequence
  Gene-specific oligonucleotide primer
gcttattagcggaattatctga

SEQ ID NO: 480 - DNA, 21 bp, Artificial Sequence
  Gene-specific oligonucleotide primer
ctggatatgcggtactcactg

SEQ ID NO: 481 - DNA, 23 bp, Artificial Sequence
  Gene-specific oligonucleotide primer
gaatttgatgaatatcgtaaggc

SEQ ID NO: 482 - DNA, 25 bp, Artificial Sequence
  Gene-specific oligonucleotide primer
gtagaatctaatacctgcataaagg

SEQ ID NO: 483 - DNA, 23 bp, Artificial Sequence
  Gene-specific oligonucleotide primer
gtattctcttatgccaaaccaat

SEQ ID NO: 484 - DNA, 22 bp, Artificial Sequence
  Gene-specific oligonucleotide primer
caaaatccctgctttagaatct

SEQ ID NO: 485 - DNA, 24 bp, Artificial Sequence
  Gene-specific oligonucleotide primer
ggcattgattagtgtaaatttagg

SEQ ID NO: 486 - DNA, 22 bp, Artificial Sequence
  Gene-specific oligonucleotide primer
ctcccagattacctataatgcg

SEQ ID NO: 487 - DNA, 27 bp, Artificial Sequence
  Gene-specific oligonucleotide primer
catttctctaacaatactttagtaggc

SEQ ID NO: 488 - DNA, 21 bp, Artificial Sequence
  Gene-specific oligonucleotide primer
ggtattcatccgctaattttg

SEQ ID NO: 489 - DNA, 18 bp, Artificial Sequence
  Gene-specific oligonucleotide primer
gttgagcaagcagaacgc

SEQ ID NO: 490 - DNA, 19 bp, Artificial Sequence
  Gene-specific oligonucleotide primer
cgaaccactttttcgttcc

SEQ ID NO: 491 - DNA, 26 bp, Artificial Sequence
  Gene-specific oligonucleotide primer
gattattgaattagatggtagtcagc

SEQ ID NO: 492 - DNA, 20 bp, Artificial Sequence
  Gene-specific oligonucleotide primer
gttggtttaccttccgcatc

SEQ ID NO: 493 - DNA, 19 bp, Artificial Sequence
  Gene-specific oligonucleotide primer
caaaagccgatccatattg

SEQ ID NO: 494 - DNA, 22 bp, Artificial Sequence
  Gene-specific oligonucleotide primer
cacaatttcaccatttttaacc

SEQ ID NO: 495 - DNA, 25 bp, Artificial Sequence
  Gene-specific oligonucleotide primer
gattatgcaaaagataaacttgaac

SEQ ID NO: 496 - DNA, 20 bp, Artificial Sequence
  Gene-specific oligonucleotide primer
gagcggttgtcattctttcc

SEQ ID NO: 497 - DNA, 18 bp, Artificial Sequence
  Gene-specific oligonucleotide primer
gcgaatttatcgtaggcg

SEQ ID NO: 498 - DNA, 24 bp, Artificial Sequence
  Gene-specific oligonucleotide primer
gctctttcactaaatctacacctg

SEQ ID NO: 499 - DNA, 20 bp, Artificial Sequence
  Gene-specific oligonucleotide primer
gtaggaatggcagttgcagc

SEQ ID NO: 500 - DNA, 22 bp, Artificial Sequence
  Gene-specific oligonucleotide primer
caatatccacttgccctaatgc

SEQ ID NO: 501 - DNA, 22 bp, Artificial Sequence
  Gene-specific oligonucleotide primer
ctaattgttgaaggaagaggag

SEQ ID NO: 502 - DNA, 22 bp, Artificial Sequence
  Gene-specific oligonucleotide primer
cttcattattttcagcaaagtg

SEQ ID NO: 503 - DNA, 21 bp, Artificial Sequence
  Gene-specific oligonucleotide primer
ggggaattcaaactaaaaatg

SEQ ID NO: 504 - DNA, 21 bp, Artificial Sequence
  Gene-specific oligonucleotide primer
cctacacgctgttttctatgg

SEQ ID NO: 505 - DNA, 22 bp, Artificial Sequence
  Gene-specific oligonucleotide primer
gtatcatttttaggacgtgcaa

SEQ ID NO: 506 - DNA, 21 bp, Artificial Sequence
  Gene-specific oligonucleotide primer
ccaagttcctttatacgttgc

SEQ ID NO: 507 - DNA, 22 bp, Artificial Sequence
  Gene-specific oligonucleotide primer
cgaaaaattatggcagagacac

SEQ ID NO: 508 - DNA, 22 bp, Artificial Sequence
  Gene-specific oligonucleotide primer
gtgacaacaggaccacgataac

SEQ ID NO: 509 - DNA, 20 bp, Artificial Sequence
  Gene-specific oligonucleotide primer
cttgttacccaccaaccatc

SEQ ID NO: 510 - DNA, 22 bp, Artificial Sequence
  Gene-specific oligonucleotide primer
ctttggtttcactgttgaaaac

SEQ ID NO: 511 - DNA, 30 bp, Artificial Sequence
  Gene-specific oligonucleotide primer
catctttaatttattcataaatacaaaatt

SEQ ID NO: 512 - DNA, 19 bp, Artificial Sequence
  Gene-specific oligonucleotide primer
cacctcaaaaactcaccgc

SEQ ID NO: 513 - DNA, 22 bp, Artificial Sequence
  Gene-specific oligonucleotide primer
gaacccataaattggtttgtcc

SEQ ID NO: 514 - DNA, 25 bp, Artificial Sequence
  Gene-specific oligonucleotide primer
caccaccataggtataatctaaacc

SEQ ID NO: 515 - DNA, 23 bp, Artificial Sequence
  Gene-specific oligonucleotide primer
caaattcataccgcacttttaag

SEQ ID NO: 516 - DNA, 20 bp, Artificial Sequence
  Gene-specific oligonucleotide primer
caatcaccaactcttcacgc

SEQ ID NO: 517 - DNA, 23 bp, Artificial Sequence
  Gene-specific oligonucleotide primer
caattcaagtgattccacatatc

SEQ ID NO: 518 - DNA, 23 bp, Artificial Sequence
  Gene-specific oligonucleotide primer
gattttttgtgattttcataggc

SEQ ID NO: 519 - DNA, 20 bp, Artificial Sequence
  Gene-specific oligonucleotide primer
cgatttatgcccctttaatg

SEQ ID NO: 520 - DNA, 25 bp, Artificial Sequence
  Gene-specific oligonucleotide primer
ctttcttgtagaaaaatacgtttct

SEQ ID NO: 521 - DNA, 21 bp, Artificial Sequence
  Gene-specific oligonucleotide primer
gatttcgttgaggttttggtc

SEQ ID NO: 522 - DNA, 22 bp, Artificial Sequence
  Gene-specific oligonucleotide primer
gaaagcaatgctgaaagtaatg

SEQ ID NO: 523 - DNA, 25 bp, Artificial Sequence
  Gene-specific oligonucleotide primer
caaggtgttatactgactgaagaac

SEQ ID NO: 524 - DNA, 22 bp, Artificial Sequence
  Gene-specific oligonucleotide primer
cgaggtgctttagaaataaatc

SEQ ID NO: 525 - DNA, 25 bp, Artificial Sequence
  Gene-specific oligonucleotide primer
ggaaaccagattttaattcattaag

SEQ ID NO: 526 - DNA, 20 bp, Artificial Sequence
  Gene-specific oligonucleotide primer
cgtattcatattggcgcaag

SEQ ID NO: 527 - DNA, 19 bp, Artificial Sequence
  Gene-specific oligonucleotide primer
gatgcgattcctcgcttag

SEQ ID NO: 528 - DNA, 24 bp, Artificial Sequence
  Gene-specific oligonucleotide primer
gaattaaaagattactgggaattg

SEQ ID NO: 529 - DNA, 23 bp, Artificial Sequence
  Gene-specific oligonucleotide primer
caggttacgatagcacaattagc

SEQ ID NO: 530 - DNA, 22 bp, Artificial Sequence
  Gene-specific oligonucleotide primer
cacgttatcaaaaggtgctttc

SEQ ID NO: 531 - DNA, 21 bp, Artificial Sequence
  Gene-specific oligonucleotide primer
gttctacggtaaaacctttcg

SEQ ID NO: 532 - DNA, 19 bp, Artificial Sequence
  Gene-specific oligonucleotide primer
ctcagaaaccaccgcactc

SEQ ID NO: 533 - DNA, 25 bp, Artificial Sequence
  Gene-specific oligonucleotide primer
cacaagaatcaaaaagtgaattaag

SEQ ID NO: 534 - DNA, 28 bp, Artificial Sequence
  Gene-specific oligonucleotide primer
cgtggtcattactaataataaattactt

SEQ ID NO: 535 - DNA, 18 bp, Artificial Sequence
  Gene-specific oligonucleotide primer
cacaaggtgctggtagcg

SEQ ID NO: 536 - DNA, 23 bp, Artificial Sequence
  Gene-specific oligonucleotide primer
ccaagtaaaaaaaagacaccaag

SEQ ID NO: 537 - DNA, 21 bp, Artificial Sequence
  Gene-specific oligonucleotide primer
cttatttttcggcggctattt

SEQ ID NO: 538 - DNA, 24 bp, Artificial Sequence
  Gene-specific oligonucleotide primer
gatgggaaatttattcaagaacag

SEQ ID NO: 539 - DNA, 22 bp, Artificial Sequence
  Gene-specific oligonucleotide primer
gagcatattgaaaatgccactg

SEQ ID NO: 540 - DNA, 22 bp, Artificial Sequence
  Gene-specific oligonucleotide primer
gtttcaaatcttcaattcggtg

SEQ ID NO: 541 - DNA, 20 bp, Artificial Sequence
  Gene-specific oligonucleotide primer
ggtagcaatgaggcaaattc

SEQ ID NO: 542 - DNA, 25 bp, Artificial Sequence
  Gene-specific oligonucleotide primer
gaacctttcatataaataagaatgg

SEQ ID NO: 543 - DNA, 21 bp, Artificial Sequence
  Gene-specific oligonucleotide primer
cagacacttgccatcaatttg

SEQ ID NO: 544 - DNA, 19 bp, Artificial Sequence
  Gene-specific oligonucleotide primer
gctgcagggacttatcgag

SEQ ID NO: 545 - DNA, 22 bp, Artificial Sequence
  Gene-specific oligonucleotide primer
cttctaaacgtgtttcctctct

SEQ ID NO: 546 - DNA, 22 bp, Artificial Sequence
  Gene-specific oligonucleotide primer
caaattttaataaatggctacg

SEQ ID NO: 547 - DNA, 22 bp, Artificial Sequence
  Gene-specific oligonucleotide primer
cttttcaatgtgggttggtatc

SEQ ID NO: 548 - DNA, 20 bp, Artificial Sequence
  Gene-specific oligonucleotide primer
ccgcacttttttcatctttc

SEQ ID NO: 549 - DNA, 25 bp, Artificial Sequence
  Gene-specific oligonucleotide primer
ctaaaataatgtaaaaaatgaccgc

SEQ ID NO: 550 - DNA, 20 bp, Artificial Sequence
  Gene-specific oligonucleotide primer
ccaacaaatgaaccattgcc

SEQ ID NO: 551 - DNA, 24 bp, Artificial Sequence
  Gene-specific oligonucleotide primer
ggtactgcttgaacattttaattc

SEQ ID NO: 552 - DNA, 20 bp, Artificial Sequence
  Gene-specific oligonucleotide primer
caagtgctttcgtttccatt

SEQ ID NO: 553 - DNA, 24 bp, Artificial Sequence
  Gene-specific oligonucleotide primer
gatggacagcagtagtcagtaatt

SEQ ID NO: 554 - DNA, 23 bp, Artificial Sequence
  Gene-specific oligonucleotide primer
ctggtataaaggcttaaggattg

SEQ ID NO: 555 - DNA, 22 bp, Artificial Sequence
  Gene-specific oligonucleotide primer
ctctgctaacgatcacaatgtg

SEQ ID NO: 556 - DNA, 21 bp, Artificial Sequence
  Gene-specific oligonucleotide primer
cacatcaatttcagcaccttt

SEQ ID NO: 557 - DNA, 23 bp, Artificial Sequence
  Gene-specific oligonucleotide primer
caaaccaatctttatgttttacg

SEQ ID NO: 558 - DNA, 19 bp, Artificial Sequence
  Gene-specific oligonucleotide primer
ccgcactttcattccattc

SEQ ID NO: 559 - DNA, 22 bp, Artificial Sequence
  Gene-specific oligonucleotide primer
gaatatgaatggcgttttaatc

SEQ ID NO: 560 - DNA, 27 bp, Artificial Sequence
  Gene-specific oligonucleotide primer
gcattaaagtctaatatgattaatcag

SEQ ID NO: 561 - DNA, 24 bp, Artificial Sequence
  Gene-specific oligonucleotide primer
ctaatccaaacgaaaaaataagtc

SEQ ID NO: 562 - DNA, 20 bp, Artificial Sequence
  Gene-specific oligonucleotide primer
cagagagataatccgcttcg

SEQ ID NO: 563 - DNA, 22 bp, Artificial Sequence
  Gene-specific oligonucleotide primer
ggggttaagtcttgatgatacg

SEQ ID NO: 564 - DNA, 23 bp, Artificial Sequence
  Gene-specific oligonucleotide primer
cagaataaagcggtaggaatttc

SEQ ID NO: 565 - DNA, 21 bp, Artificial Sequence
  Gene-specific oligonucleotide primer
ctaattatgaagcaggctggg

SEQ ID NO: 566 - DNA, 21 bp, Artificial Sequence
  Gene-specific oligonucleotide primer
ccattaaaaaagcgtgttttg

SEQ ID NO: 567 - DNA, 21 bp, Artificial Sequence
  Gene-specific oligonucleotide primer
cggtgaaatggyatcgcaaag

SEQ ID NO: 568 - DNA, 27 bp, Artificial Sequence
  Gene-specific oligonucleotide primer
cctctatttagcttgccataatattcg

SEQ ID NO: 569 - DNA, 28 bp, Artificial Sequence
  Gene-specific oligonucleotide primer
ctcgtttagatttagataaaaaatttac

SEQ ID NO: 570 - DNA, 22 bp, Artificial Sequence
  Gene-specific oligonucleotide primer
caaaagccacatcatattcaag

SEQ ID NO: 571 - DNA, 18 bp, Artificial Sequence
  Gene-specific oligonucleotide primer
catttgggctgcctgaag

SEQ ID NO: 572 - DNA, 19 bp, Artificial Sequence
  Gene-specific oligonucleotide primer
gggccatagcaacaaattc

SEQ ID NO: 573 - DNA, 23 bp, Artificial Sequence
  Gene-specific oligonucleotide primer
caagcatctcctgtaatttattt

SEQ ID NO: 574 - DNA, 24 bp, Artificial Sequence
  Gene-specific oligonucleotide primer
caatattatcgaaatcgctataat

SEQ ID NO: 575 - DNA, 25 bp, Artificial Sequence
  Gene-specific oligonucleotide primer
cctagcttgtgctatgttagatatg

SEQ ID NO: 576 - DNA, 22 bp, Artificial Sequence
  Gene-specific oligonucleotide primer
gttatccacaagtgtgcaaatg

SEQ ID NO: 577 - DNA, 25 bp, Artificial Sequence
  Gene-specific oligonucleotide primer
gttgtaatttattaggcattaaacc

SEQ ID NO: 578 - DNA, 22 bp, Artificial Sequence
  Gene-specific oligonucleotide primer
cgcttgtgattaaatggtttac

SEQ ID NO: 579 - DNA, 23 bp, Artificial Sequence
  Gene-specific oligonucleotide primer
cgattacatcaagaactgaaagg

SEQ ID NO: 580 - DNA, 22 bp, Artificial Sequence
  Gene-specific oligonucleotide primer
gattctacacctgaattaccgc

SEQ ID NO: 581 - DNA, 20 bp, Artificial Sequence
  Gene-specific oligonucleotide primer
cgatgaatatgtggatcgtg

SEQ ID NO: 582 - DNA, 20 bp, Artificial Sequence
  Gene-specific oligonucleotide primer
gtgattaacacatccgttgg

SEQ ID NO: 583 - DNA, 26 bp, Artificial Sequence
  Gene-specific oligonucleotide primer
gaaaacttaccaacttttattaaacc

SEQ ID NO: 584 - DNA, 20 bp, Artificial Sequence
  Gene-specific oligonucleotide primer
caaagcaaacaatgccgtag

SEQ ID NO: 585 - DNA, 20 bp, Artificial Sequence
  Gene-specific oligonucleotide primer
cggcatgatgttcgatttag

SEQ ID NO: 586 - DNA, 21 bp, Artificial Sequence
  Gene-specific oligonucleotide primer
gagtttgttgggcatctaatg

SEQ ID NO: 587 - DNA, 18 bp, Artificial Sequence
  Gene-specific oligonucleotide primer
cttttgcaggcgtaaccc

SEQ ID NO: 588 - DNA, 22 bp, Artificial Sequence
  Gene-specific oligonucleotide primer
cgtcaaaaaggcaaagttctac

SEQ ID NO: 589 - DNA, 24 bp, Artificial Sequence
  Gene-specific oligonucleotide primer
cccttagatttgtatagaatagcc

SEQ ID NO: 590 - DNA, 20 bp, Artificial Sequence
  Gene-specific oligonucleotide primer
cgtaaacctgaaatggttgg

SEQ ID NO: 591 - DNA, 29 bp, Artificial Sequence
  Gene-specific oligonucleotide primer
gaaattgttctattcaatataattgatag

SEQ ID NO: 592 - DNA, 20 bp, Artificial Sequence
  Gene-specific oligonucleotide primer
ggaaaatgaaagcctgattg

SEQ ID NO: 593 - DNA, 20 bp, Artificial Sequence
  Gene-specific oligonucleotide primer
cgccatttgtatttaagctg

SEQ ID NO: 594 - DNA, 24 bp, Artificial Sequence
  Gene-specific oligonucleotide primer
cattcggttcaatatgtagttctg

SEQ ID NO: 595 - DNA, 20 bp, Artificial Sequence
  Gene-specific oligonucleotide primer
caagaattcaaccccaccac

SEQ ID NO: 596 - DNA, 19 bp, Artificial Sequence
  Gene-specific oligonucleotide primer
ccccaatccccctaaattc

SEQ ID NO: 597 - DNA, 22 bp, Artificial Sequence
  Gene-specific oligonucleotide primer
gatattttaatgaatgcgcttg

SEQ ID NO: 598 - DNA, 22 bp, Artificial Sequence
  Gene-specific oligonucleotide primer
cagggaatagaagagtttgagc

SEQ ID NO: 599 - DNA, 23 bp, Artificial Sequence
  Gene-specific oligonucleotide primer
gaactgaaagaatggtttcaaac

SEQ ID NO: 600 - DNA, 19 bp, Artificial Sequence
  Gene-specific oligonucleotide primer
cgccattaatgctttcgtt

SEQ ID NO: 601 - DNA, 21 bp, Artificial Sequence
  Gene-specific oligonucleotide primer
cgatttagccaaacaaaaagc

SEQ ID NO: 602 - DNA, 23 bp, Artificial Sequence
  Gene-specific oligonucleotide primer
ggtagatagtcaggcaaaatttg

SEQ ID NO: 603 - DNA, 19 bp, Artificial Sequence
  Gene-specific oligonucleotide primer
cgacaaattacgcgtaggc

SEQ ID NO: 604 - DNA, 25 bp, Artificial Sequence
  Gene-specific oligonucleotide primer
gaacctattgtgtatcgatttgatg

SEQ ID NO: 605 - DNA, 23 bp, Artificial Sequence
  Gene-specific oligonucleotide primer
gatgacttacgcttcaaaaagtg

SEQ ID NO: 606 - DNA, 23 bp, Artificial Sequence
  Gene-specific oligonucleotide primer
ggtagaacggtggactgttaatc

SEQ ID NO: 607 - DNA, 20 bp, Artificial Sequence
  Gene-specific oligonucleotide primer
cgcctacacctaaatgaggc

SEQ ID NO: 608 - DNA, 20 bp, Artificial Sequence
  Gene-specific oligonucleotide primer
cttttgcgttttcggctaag

SEQ ID NO: 609 - DNA, 22 bp, Artificial Sequence
  Gene-specific oligonucleotide primer
gcaaaaattgaactttcatcag

SEQ ID NO: 610 - DNA, 25 bp, Artificial Sequence
  Gene-specific oligonucleotide primer
gaagagcggtgaattatttattatc

SEQ ID NO: 611 - DNA, 21 bp, Artificial Sequence
  Gene-specific oligonucleotide primer
cagtttcagctttcaagcctc

SEQ ID NO: 612 - DNA, 23 bp, Artificial Sequence
  Gene-specific oligonucleotide primer
ctttacccacttttaatcgacac

SEQ ID NO: 613 - DNA, 22 bp, Artificial Sequence
  Gene-specific oligonucleotide primer
gtagaggaaaatggaaaacgtg

SEQ ID NO: 614 - DNA, 19 bp, Artificial Sequence
  Gene-specific oligonucleotide primer
ggtgcattagaacaagcgg

SEQ ID NO: 615 - DNA, 22 bp, Artificial Sequence
  Gene-specific oligonucleotide primer
cacaaattggtttactcttgcc

SEQ ID NO: 616 - DNA, 23 bp, Artificial Sequence
  Gene-specific oligonucleotide primer
cttaaaatccctgttaagccact

SEQ ID NO: 617 - DNA, 27 bp, Artificial Sequence
  Gene-specific oligonucleotide primer
gtttgaaatctaaagagtttgaactag

SEQ ID NO: 618 - DNA, 21 bp, Artificial Sequence
  Gene-specific oligonucleotide primer
cattttctgctccatatcctg

SEQ ID NO: 619 - DNA, 21 bp, Artificial Sequence
  Gene-specific oligonucleotide primer
ataaaaataatgccgaaatcc

SEQ ID NO: 620 - DNA, 21 bp, Artificial Sequence
  Gene-specific oligonucleotide primer
gaacccttcacggtagttaaa

SEQ ID NO: 621 - DNA, 20 bp, Artificial Sequence
  Gene-specific oligonucleotide primer
cacagcctccattacaccac

SEQ ID NO: 622 - DNA, 23 bp, Artificial Sequence
  Gene-specific oligonucleotide primer
gagtacaagcattgttgctaaac

SEQ ID NO: 623 - DNA, 20 bp, Artificial Sequence
  Gene-specific oligonucleotide primer
caacaggcgaaatcggtaaa

SEQ ID NO: 624 - DNA, 20 bp, Artificial Sequence
  Gene-specific oligonucleotide primer
ccaaagtgcggtgctaattc

SEQ ID NO: 625 - DNA, 32 bp, Artificial Sequence
  Gene-specific oligonucleotide primer
ctaagatagataaaattaaattaagtaaaaac

SEQ ID NO: 626 - DNA, 21 bp, Artificial Sequence
  Gene-specific oligonucleotide primer
cccgcataaataagtaaagcc

SEQ ID NO: 627 - DNA, 26 bp, Artificial Sequence
  Synthetic oligonucleotide
  misc_feature (1)..(1): n is inosine
  misc_feature (3)..(3): n is inosine
  misc_feature (5)..(5): n is inosine
  misc_feature (7)..(7): n is inosine
  misc_feature (9)..(9): n is inosine
  misc_feature (11)..(11): n is inosine
  misc_feature (13)..(13): n is inosine
  misc_feature (15)..(15): n is inosine
  misc_feature (17)..(17): n is inosine
  misc_feature (19)..(19): n is inosine
  misc_feature (21)..(21): n is inosine
  misc_feature (23)..(23): n is inosine
  misc_feature (25)..(25): n is inosine
ncncncncncncncncncncncncnc

SEQ ID NO: 628 - protein, 11 aa, Artificial Sequence
  Synthetic peptide
KLKLLLLLKLK

SEQ ID NO: 629 - protein, 36 aa, Mus musculus
RLAGLLRKGGEKIGEKLKKIGQKIKNFFQKLVPQPE

SEQ ID NO: 630 - DNA, 2478 bp, Artificial Sequence
  Construct 1: NTHI0007-1 nt
gctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagaattttggaaaaattttggtgagtcaaatgatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaa

SEQ ID NO: 631 - DNA, 2478 bp, Artificial Sequence
  Construct 1m: NTHI0007-1 nt
gctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgtcacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagaattttggaaaaattttggtgagtcaaatgatgtaaatcctgcagaaattcaaacagaagttttccgtttaccaactccttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaa

SEQ ID NO: 632 - DNA, 537 bp, Artificial Sequence
  Construct 2: NTHI0007-2 nt
aatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatggacgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggca

SEQ ID NO: 633 - DNA, 717 bp, Artificial Sequence
  Construct 3: NTHI0358-1 nt
ttatggaattggaatgagccaagtgatagtgcaaatagcgcacaaggcgatatatctacaagtatttctatggaactattacagggcatggtgttggaagaacctgctccagagccagaagatgtacaaaaagagccagagcctgagccagaaaatgtacaaaaagagccagaaccagaaaaacaagaaattgtagaagatccaacaataaaacctgaaccgaaaaaaatcaaagaaccagaaaaggaaaagccaaaaccaaaagaaaagccgaagaataaacctaaaaaagaggttaaaccacaaaagaaaccaatcaataaagagctaccaaaaggcgatgaaaatattgattcaagtgccaacgtaaatgataaagcaagtacaacaagtgcagctaatagcaatgcacaggtagcaggaagtggaacggatacgagtgaaatagcggcttaccgttctgcaatccgccgtgaaattgaaagccataaacgttatccaactcgagcgaagataatgcgcaaacaaggaaaagtgagtgtatcttttaatgtaggagctgatggttcattaagtggtgctaaggttacaaaatcctcaggcgatgaaagtttagataaggcggcattagacgctattaacgtatctcgctctgttggaacaagacccgcaggattcccttcgagtttaagtgtgcaaattagttttactcttcaa

SEQ ID NO: 634 - DNA, 2064 bp, Artificial Sequence
  Construct 4: NTHI0369-1 nt
caatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttc

SEQ ID NO: 635 - DNA, 2064 bp, Artificial Sequence
  Construct 4m: NTHI0369-1 nt
caatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcgcggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttc

SEQ ID NO: 636 - DNA, 1617 bp, Artificial Sequence
  Construct 5: NTHI0370-1 nt
ttaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttc

SEQ ID NO: 637 - DNA, 831 bp, Artificial Sequence
  Construct 6: NTHI0371-1 nt
acacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggct

SEQ ID NO: 638 - DNA, 1290 bp, Artificial Sequence
  Construct 7: NTHI0525 nt
atggatttactttcagacattgaaaaacaactccaaaaagccaccgctcaagggtttcttatcgccttgagtggtggtttagattccactgtacttctttctttatttgcaaaactttgtcaaaaacaaccgcacttaccgcctttatcggtacgagcaatccacattcatcacggcttaagccccaatgcagatagttgggctaaacactgccaaaacttgtgcgatcaatttcaaattccattgattatcgagcgagtacaagtagataaaaccaatggcattgaagcaggggcgcgtgaagcacgctatcaagccataaaaaaacatcttcaaatacaagaaatgttagttacagcgcatcatctaaacgatcaaacagaaacatttttcttagccctaaaacgtggcagtgggctacaaggcttaagcgcaatgcaacaacaaagtgtattattcggaatgccaatttttcgccctttgttaggttttactcgcccacagttagaagattatgcgcaacaagaaaagctcaactgggttacagatgaaagtaatgaggataatcgatacgatcgtaatttcttacgcaatgaaattttgccaaaattacgtgaacgctgggcgcattttgatttagccgtacaacgttccgcacaacattgttttgagcaacaacagttaattaatgatttattgagcgaaatttttacagaacattgtcaaattaaaaaccaatttaaactgctccaatttcgccaatattctctcgcaaaacagaccgcacttttgcgtatgtggcttgccaaaaaccaacttgaaatgccaagtaaacgccagcttacacagcttattaatgatgtcatttttgcaaaagaagaggcaaatcctcaatttcagcttgtaaataaagttattcgacgttatcaagatagtttatatttaactaagccgttttctgatctaaccaaatgcaccctaaaattagaacaaaacatgctaaatttacccgatgatttaggcaatctcactgttcacgaaaatgaacataatctgattttctactggcaggattactctgttacgctggaaaaaacgaacttgcctatttctattcgttttggctattcgggcaaagtgaaacatcatccgaaacgcccaagagaagatataaaaaaaatctggcaagaattaagcgtaccaccttgggaacgaaatcggatccctttaattttttatggcaatgagctaaaaagtgcggtcggttttttccgtgtttttgacgaatat

SEQ ID NO: 639 - DNA, 1290 bp, Artificial Sequence
  Construct 7m: NTHI0525 nt
atggatttactttcagacattgaaaaacaactccaaaaagccaccgctcaagggtttcttatcgccttgagtggtggtttagattccactgtacttctttctttatttgcaaaactttgtcaaaaacaaccgcacttaccgcctttatcggtacgagcaatccacattcatcacggcttaagccccaatgcagatagttgggctaaacactgccaaaacttgtgcgatcaatttcaaattccattgattatcgagcgagtacaagtagataaaaccaatggcattgaagcaggggcgcgtgaagcacgctatcaagccataaaaaaacatcttcaaatacaagaaatgttagttacagcgcatcatctaaacgatcaaacagaaacatttttcttagccctaaaacgtggcagtgggctacaaggcttaagcgcaatgcaacaacaaagtgtattattcggaatgccaatttttcgccctttgttaggttttactcgcccacagttagaagattatgcgcaacaagaaaagctcaactgggttacagatgaaagtaatgaggataatcgatacgatcgtaatttcttacgcaatgaaattttgccaaaattacgtgaacgctgggcgcattttgatttagccgtacaacgttccgcacaacattgttttgagcaacaacagttaattaatgatttattgagcgaaatttttacagaacattgtcaaattaaaaaccaatttaaactgctccaatttcgccaatattctctcgcaaaacagaccgcacttttgcgtatgtggcttgccaaaaaccaacttgaaatgccaagtaaacgccagcttacacagcttattaatgatgtcatttttgcaaaagaagaggcaaatcctcaatttcagcttgtaaataaagttattcgacgttatcaagatagtttatatttaactaagccgttttctgatctaaccaaatgcaccctaaaattagaacaaaacatgctaaatttactcgatgatttaggcaatctcactgttcacgaaaatgaacataatctgattttctactggcaggattactctgttacgctggaaaaaacgaacttgcctatttctattcattttggctattcgggcaaagtgaaacatcatccgaaacgcccaagagaagatataaaaaaaatctggcaagaattaagcgtaccaccttgggaacgaaatcggatccctttaattttttatggcaatgagctaaaaagtgcggtcggttttttccgtgtttttgacgaatat

SEQ ID NO: 640 - DNA, 876 bp, Artificial Sequence
  Construct 8: NTHI0716-1 nt
gaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagcgcattatatagtgatggcttatttacttttacgttgtttgtctctaatgtaagctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttaga

SEQ ID NO: 641 - DNA, 1146 bp, Artificial Sequence
  Construct 9: NTHI0782-1 nt
gctcaaccaaccaaccaaccaaccaaccaaccaaccaaccaaccaaccaaccaaaatggtaatgtttctgaacaactagagcaaattaatgtatctggttctaccgaaaatagtgatacaaaaacaccaccaaaaattgctgaaacggtaaaaacggctaaaacgctggaaagagaacaagcaaacaatattaaagacatcgttaaatacgagacgggcgttactgttgttgaagctgggcgttttgggcaaagcggttttgccattcgtggtgtagatgaaaaccgtgtagcgattaatattgatggattacgtcaagctgaaaccctatcttctcaaggctttaaagagctttttgagggttatggtaacttcaataatacgcgtaatggtgcagaaattgaaactttaaaagaagtaaatattacaaaaggggcaaattcaatcaaaagtggtagtggttccttaggtggatctgtaatttataaaacaaaagatgcgagagattatctccttaacaaggattactatgtaagctacaaaaagggatacgctacagaaaataatcaatcattcaatacccttactcttgcaggacgttataaaaagtttgatgccttagtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaattaacagatgggaaaataacacgtcgagatggttcagaacttcaatttgaaaaaaaagataaaaat

SEQ ID NO: 642 - DNA, 927 bp, Artificial Sequence
  Construct 10: NTHI0782-4 nt
gtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttt

SEQ ID NO: 643 - DNA, 1161 bp, Artificial Sequence
  Construct 11: NTHI0830-1 nt
acctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgt

SEQ ID NO: 644 - DNA, 1167 bp, Artificial Sequence
  Construct 12: NTHI1063-1 nt
acgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtacctgtgcgaattaaattagatccacaacaatttacagaaacgccattgagaattggtctttctgcaacggcaaaagtaagaatttcagattcatcaggcgcaatgctacgagaaaaaacagaaccgaaaacgttattttctactgatacacttaaatatgatgaaagtgcggtagaaaatttgattgaatctatcattcagcaaaacagccat

SEQ ID NO: 645 - DNA, 1299 bp, Artificial Sequence
  Construct 13: NTHI1164-2 nt
ggattaattacaaatccaagtcaggtcactatatatacaccagcaataaccgccgatgatgataattattactatgtgccatctattccaagaggaaaagatctttactttagtaatacctgttataaatactatgcgttaaagcaaggtggaagccctactgcagaaatgccttgctatagctctgaaaaatcagatgctaattgggaattcatgggcgacaatcaaaatgatgcacaaaagaaagccatggtgtacatcaataacagacgtatgaatggctttaatggttattttggcgaggaagcaactaaggcagatcaaaacggtaaattaaatgttacctttagtggcaaaagtgatcaaaatcgctttttattgactggcggaacaaaccttaacggtgaattaaaagttgaaaaaggtacattattcctttctggcagaccaacaccacacgcaagagatattgcaaatatttcttcaacagaaaaagataaacactttgctgaaaataatgaagtggtggtagaagacgactggattaaccgcacttttaaagcaacaaatattaatgtaaccaataacgcaaccctttattcaggtcgcaatgttgaaagtattacttcaaatatcacagcctctaataaagcaaaagtgcatatcggctataaagcaggcgataccgtttgtgtacgttctgactatacgggctatgtgacttgccataatgacactttatctacaaaagcactcaatagttttaatccaactaatttgcgcggtaatgtaaatttaaccgaaagtgcaaactttaccttaggcaaagctaacttatttggcacaattaacagcacggaaaatagccaagttaatttaaaagaaaacagccattggtatttaacaggaaatagtgatgttcatcaattagatctagcaaatgggcatattcatttaaataatgtctcagatgcaacaaaagaaacaaaataccacacgctcaatattagcaatttatcaggtaatggttctttctattattgggttgattttaccaaaaatcagggcgacaaagttgttgtaaccaaatcagccaaaggtacctttacattacaagtggcaaataaaacaggcgagccaaatcataatgaacttacgctttttgatgcgtcaaatgcaactgaaagaagtggcttaaatgtttcactggctaatggcaaagttgatcgaggtgcttggagctatactttgaaagaaaatagtggacgttattacttgcataacccagaagtagaaaga

SEQ ID NO: 646 - DNA, 1137 bp, Artificial Sequence
  Construct 14: NTHI1169-2 nt
agaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaag

SEQ ID NO: 647 - DNA, 447 bp, Artificial Sequence
  Construct 15: NTHI1342-1 nt
aatatttatgctgagggcgatatcggtttatctcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttc

SEQ ID NO: 648 - DNA, 816 bp, Artificial Sequence
  Construct 16: NTHI1390-1 nt
gaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtgtcgtttctgtaaatattcgtggcgaaaatggattaggtcgtgtcaatacgatggttgatggtgtaacccaaaccttctattctacagccttagactctggtcaatcaggcggaagttctcaatttggtgcggcaatcgatcctaattttattgcaggtgtagatgttaataaaagtaacttttcgggagcaagcggtataaatgcgttagcaggcagtgctaattttagaacattaggcgttaatgatgttattaccgatgacaaaccatttggcattattctgaaaggaatgacaggaagcaatgccactaaatccaattttatgacgatggctgctggcagaaaatggcttgataatggtggctatgtaggcgtggtgtatggttatagccaacgtgaagtttcacaagattaccgtattggaggcggagaacgattagcatcattagggcaagatattctcgcgaaagaaaaagaagcttattttcgtaatgcgggttatgttttaaatgatgctggacagtggactcctgatctaagtaagaacgcttggtcttgtaacgaagaccctcctcgtttagcagagaatatagagaatgttaaatgtacacattattcttttgatcctagaaaaaacgat

SEQ ID NO: 649 - DNA, 510 bp, Artificial Sequence
  Construct 17: NTHI1667-1 nt
ggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaa

SEQ ID NO: 650 - protein, 826 aa, Artificial Sequence
  Construct 1: NTHI0007-1 aa
  MISC_FEATURE (172)..(172): Xaa is selenocysteine
AAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTXHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDRDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWKNFGESNDVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYE

SEQ ID NO: 651 - protein, 826 aa, Artificial Sequence
  Construct 1m: NTHI0007-1 aa
AAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTCHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDRDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWKNFGESNDVNPAEIQTEVFRLPTPCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYE

SEQ ID NO: 652 - protein, 179 aa, Artificial Sequence
  Construct 2: NTHI0007-2 aa
NGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 653 - protein, 239 aa, Artificial Sequence
  Construct 3: NTHI0358-1 aa
LWNWNEPSDSANSAQGDISTSISMELLQGMVLEEPAPEPEDVQKEPEPEPENVQKEPEPEKQEIVEDPTIKPEPKKIKEPEKEKPKPKEKPKNKPKKEVKPQKKPINKELPKGDENIDSSANVNDKASTTSAANSNAQVAGSGTDTSEIAAYRSAIRREIESHKRYPTRAKIMRKQGKVSVSFNVGADGSLSGAKVTKSSGDESLDKAALDAINVSRSVGTRPAGFPSSLSVQISFTLQ

SEQ ID NO: 654 - protein, 688 aa, Artificial Sequence
  Construct 4: NTHI0369-1 aa
QSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSTVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPETAKNKEITANLHFDSLFKQGDKFKIEATYFRNDVKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 655 - protein, 688 aa, Artificial Sequence
  Construct 4m: NTHI0369-1 aa
QSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSAVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPETAKNKEITANLHFDSLFKQGDKFKIEATYFRNDVKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 656 - protein, 539 aa, Artificial Sequence
  Construct 5: NTHI0370-1 aa
LGQPDTGSLNRELEQRRIQPEAKPSGELFNQAAKSPYTAQYKQELKFPLTQVQILDRNNQEVVTDELAHILKNYVGKEVSLSDLSNLANEISEFYRNNNYLVAKAILPPQEIEQGTVKILLLKGNVGEIRLQNHSALSNKFVSRLSNTTVNTSEFILKDELEKFALTINDVPGVNAGLQLSAGKKVGEANLLIKINDAKRFSSYVSVDNQGNKYTGRYRLAAGTKVNNLTGWGDELKLDLLSSNQANLKNARIDYSSLIDGYSTRFGVTANYLHYKLGGNFKSLQSQGHSHNLGAYLLHPTIRTPNFRLSTKVSFNHQNLTDEQQAVTVKQKRKINSLTVGIDGSWNLIKDGTTYFSLSTLFGNLANQTNEKKHNAKEDFQPQSHFTVYNYRLSHEQILPKSFAFNIGINGQFADKTLESSQKMLLGGLSGVRGHQAGAASVDEGHLIQTEFKHYLPVFSQSVLVSSLFYDYGFGKYYKNSQSLAQSVKNSVKLQSVGAGLSFSDAGSYAINVSVAKPLDNNIDNADKHQFWLSMIKTF

SEQ ID NO: 657 - protein, 277 aa, Artificial Sequence
  Construct 6: NTHI0371-1 aa
TQGLPQEGLPQEDTVVFGNVTIDKTTADKMTITQSSPTTQINWKSFDIGQNKEVEFKQPSPNAVAYNRVTGGNASQIQGKLTANGKVYLANPNGVIITKGAEINVAGLLATTKDLEQISENGNGNGNSYQFTRKTKDGQELKEGKVLNEGKIKAKDFVVLNGDEVINKEEINVTNGKVYLSSGDNFTFTLLPDSGISVALEDNAVRGIVKNEGIIKAEDITLNAKGRKEALDSLVMNNGVLEATKVSNKNGKVVLSADEIKLDDKSNIKGDMVSFVA

SEQ ID NO: 658 - protein, 430 aa, Artificial Sequence; identical to SEQ ID NO: 205
  Construct 7: NTHI0525 aa

SEQ ID NO: 659 - protein, 430 aa, Artificial Sequence
  Construct 7m: NTHI0525 aa
MDLLSDIEKQLQKATAQGFLIALSGGLDSTVLLSLFAKLCQKQPHLPPLSVRAIHIHHGLSPNADSWAKHCQNLCDQFQIPLIIERVQVDKTNGIEAGAREARYQAIKKHLQIQEMLVTAHHLNDQTETFFLALKRGSGLQGLSAMQQQSVLFGMPIFRPLLGFTRPQLEDYAQQEKLNWVTDESNEDNRYDRNFLRNEILPKLRERWAHFDLAVQRSAQHCFEQQQLINDLLSEIFTEHCQIKNQFKLLQFRQYSLAKQTALLRMWLAKNQLEMPSKRQLTQLINDVIFAKEEANPQFQLVNKVIRRYQDSLYLTKPFSDLTKCTLKLEQNMLNLLDDLGNLTVHENEHNLIFYWQDYSVTLEKTNLPISIHFGYSGKVKHHPKRPREDIKKIWQELSVPPWERNRIPLIFYGNELKSAVGFFRVFDEY

SEQ ID NO: 660 - protein, 292 aa, Artificial Sequence
  Construct 8: NTHI0716-1 aa
EELSAKQSLDKMTQALDNLNYEIAFVQTTPANMDSFRYRHIKQDNKTYAQLVTLDGRQQEIIQRDNLVSYFQPNAQAFTLNSGNIVDAMPAVVRANFDKLSSDYDFVKLGKDRVAGRFADTIRIVPKDDFRYQYLVFIDEENGLLLRSDMLDREGKLLDQFRVVTLYIDDRLRGLTDYINKVSLPPLLKESKNEQSSDITWSAGWLPQGFSLIRYTQEILENEIIDSALYSDGLFTFTLFVSNVSSNDLPENTWKQGAYTIYSEVIGGKEITFIGQLPISTAKRIVQEVKFR

SEQ ID NO: 661 - protein, 382 aa, Artificial Sequence
  Construct 9: NTHI0782-1 aa
AQPTNQPTNQPTNQPTNQNGNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTSRNGHELENYDYKNANSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPAGLKLTDGKITRRDGSELQFEKKDKN

SEQ ID NO: 662 - protein, 309 aa, Artificial Sequence
  Construct 10: NTHI0782-4 aa
VQQNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLIFKGEKDFKLVSGGSTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 663 - protein, 387 aa, Artificial Sequence
  Construct 11: NTHI0830-1 aa
TSNSPAPISDADGNLSPSVVQSVNGSNVGGAWQPEIQKNSLPTMGNMVTPQPNFQPINQQPAMPTKPAQPAFQPSPKTVVSAPTVQTKTVTKTIADCVDGQHINIPRNPNTNAPDYSKISKGSYKGNTYKVNKGDTMFLIAYLAGIDVKELAALNNLSEPYNLSLGQVLKISNCGTKTVTTTVSVKQPAVTASTAMPAKPAVTYTPGANGTQIGSDGTIIGPIKSEAGISSSVSVATSSTQVTSSVNNANSTPINANVVAPIASNVAWQWPTSGNIIQGFSSTDGGNKGIDISGSRGQAVKAAAAGRIVYAGNALRGYGNLIIIKHNDDFLSAYAHNDKILVADQQEVKAGQDIAKMGSSGTNTVKLHFEIRYKGKSVDPVRYLPKR

SEQ ID NO: 664 - protein, 389 aa, Artificial Sequence
  Construct 12: NTHI1063-1 aa
TKTAIETPSNKSVSNKTNRKKGLSIFILLLLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHANEISLAQAQGNLARRVQLEKMGAIDKESFQHAKEAVELAKANLNASKNQLAANQALLRNVPLREQPQIQNAINSLKQAWLNLQRTKIRSPIDGYVARRNVQVGQAVSVGGALMAVVSNEQMWLEANFKETQLTNMRIGQPVKIHFDLYGKNKEFDGVINGIEMGTGNAFSLLPSQNATGNWIKVVQRVPVRIKLDPQQFTETPLRIGLSATAKVRISDSSGAMLREKTEPKTLFSTDTLKYDESAVENLIESIIQQNSH

SEQ ID NO: 665 - protein, 433 aa, Artificial Sequence
  Construct 13: NTHI1164-2 aa
GLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVER

SEQ ID NO: 666 - protein, 379 aa, Artificial Sequence
  Construct 14: NTHI1169-2 aa
RKTDIQQYEKEKLYDIDAHIYSNRFRGKVTPTKSTSDEHPFTSEGTLEGGFYGPNAEELGGKFLARDKRVFGVFSAKETPETEKEKLSKETLIDGKLITFSTKTADATTSTTASTTADVKTDEKNFTTKDISSFGEADYLLIDNYPVPLFPEGDTDDFVTSKHHDIGNKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQVEKTNK

SEQ ID NO: 667 - protein, 149 aa, Artificial Sequence
  Construct 15: NTHI1342-1 aa
NIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIELGYGVVAGAKYKLDGNWYANGGVEYNRLGNFDSTKVNNYGAKVGVGYGF

SEQ ID NO: 668 - protein, 272 aa, Artificial Sequence
  Construct 16: NTHI1390-1 aa
ETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNDAGQWTPDLSKNAWSCNEDPPRLAENIENVKCTHYSFDPRKND

SEQ ID NO: 669 - protein, 170 aa, Artificial Sequence
  Construct 17: NTHI1667-1 aa
GCFDKQEAKQKVEDTKQTVASVASETKDAAANTMTEVKEKAQQLSTDVKNKVAEKVEDAKEVIKSATETASEKATEIKEAVSEKASEMKEAASEKASEMKEAASEKASEMKEAASEKASEMKEAASEKASEMKEAASEKVGEMKEKATEMKEAVSEKATQAVDAVKEATK

The invention claimed is:

1. A purified and isolated antigen consisting of: (i) an isolated polypeptide of SEQ ID NO: 656 or a polypeptide that has least 96% sequence identity to the amino acid sequence set forth as SEQ ID NO: 656, where in the antigen is 539 amino acids in length; or (ii) an immunogenic fragment of SEQ ID NO: 191, wherein the fragment consisting of amino acids 1-33, 60-66, 68-81, 86-100, 102-111, 126-137, 140-150, 163-171, 189-210, 214-221, 227-234, 263-269, 280-287, 295-302, 309-314, 318-328, 336-343, 350-356, 363-369, 381-390, 408-432, 449-461, 463-498, 506-530, 532-544, 65-402, 405-565, 66-151 or 192-261 of SEQ ID NO 191.

2. A fusion protein comprising the antigen according to claim 1, and a heterologous amino acid sequence.

3. The fusion protein according to claim 2, wherein the heterologous amino acid sequence is a marker protein.

4. The fusion protein according to claim 2, wherein the heterologous amino acid sequence is a secretory sequence, a sequence employed for purification, or a proprotein sequence.

5. A fusion protein comprising 2 or more fragments set forth in claim 1, wherein the fusion protein is less than 565 amino acids in length.

6. An immunogenic composition, comprising a purified and isolated antigen, or an immunogenic fragment thereof, as set forth in claim 1, or a fusion protein as set forth in claim 2.

7. A method for eliciting an immune response in an animal or human, comprising administering to said animal or human an amount of the immunogenic composition of claim 6 effective to elicit an immune response.

8. A method for eliciting an immune response in an animal or human, comprising administering to said animal or human an amount of the antigen, or immunogenic fragment thereof, as set forth in claim 1, or a fusion protein as set forth in claim 2, effective to elicit an immune response.

* * * * *